United States Patent 7,469,185 (PRIMARY RAT HEPATOCYTE TOXICITY MODELING) - sequence listing, part 3

SEQ ID NO: 4071 - DNA, 2870 bp, Rattus norvegicus
  Genbank Accession No. NM_053864
gaattccggcgtttgcagccgtcgtttgattagtcgcctctcgcggattaggagctagcgtctcccgcccgcctgccgccccggtgccgctgggaggaagcgagagggaggctgcctgtgggtttgtcactgctgttgctcctccacctgagtgagtcaagcccgggcctagtcggtcgcctaccattctcgtagccgttaccctcaggccgccacagccgccgaccgggagaggcgcgcgccatggcctctggagccgattcaaaaggtgatgatttatcaacagccattctcaaacagaagaaccgtcccaatcggttaattgttgatgaagccatcaatgaagataacagtgtggtgtccttgtcccagcccaagatggatgaactacagttgttcagaggtgacacggtgttgctaaaaggaaagaagagaagggaagctgtatgcattgttctttctgatgacacgtgttctgatgagaagattcgaatgaatagagttgttcggaataacctccgagttcgcctaggagatgtcatcagcatccagccatgccctgatgtaaagtatggcaaacgtatccatgtgctacccattgatgacacagtggaaggcatcactggcaatctttttgaggtataccttaagccgtacttcctggaagcatatcggcccatccgtaaaggagatattttccttgtccggggtgggatgcgtgctgtggagttcaaagtagtagagacagatcccagcccttactgtattgttgctccagacacagtgatccactgtgagggggagccaatcaagcgagaggatgaggaggagtccttgaatgaagtaggctatgatgacatcggtggttgcaggaagcagctagctcagataaaggagatggtggagctgccactgagacatcctgcactctttaaggcaattggtgtgaagcctcctcggggaatcttgctatatggacctcctgggacagggaaaaccttgattgcccgagctgtggcaaatgaaactggagccttcttctttctgatcaatggtcctgaaatcatgagcaaattggctggtgagtctgagagcaaccttcgtaaagcctttgaggaagctgaaaagaatgctcctgccatcatcttcatcgacgagcttgatgccattgcacccaaaagagagaaaactcacggggaagtggagcgtcgcatcgtgtctcagttgttgacccttatggatggcctaaagcagagagcacatgtgatagttatggcagcaaccaatagacccaacagcattgacccagccctacggcgatttggtcgctttgacagagaggtagatattggaatccctgatgctacaggacgtttggaaattcttcagatccataccaagaacatgaaactggcagatgatgtggacttggaacaggtagccaatgagactcatggtcatgtgggtgctgacttggcagccctgtgttcagaggctgctctacaggccatccggaaaaaaatggacctcattgacctagaagatgagaccattgacgctgaggtcatgaattccctggcagttactatggatgacttccggtgggccttaagtcaaagcaacccatcagcacttcgggaaactgtggtagaagtgccacaagtaacctgggaagacattggaggcctggaggatgtcaaacgggagcttcaggagttggttcagtatcctgtggagcatccagacaaattcctcaaatttggcatgactccttccaaaggtgttcttttctatggaccgcctggctgtgggaaaaccttactggccaaagccattgctaatgaatgccaggctaacttcatctccatcaagggtcctgagctgcttaccatgtggtttggggaatctgaggccaatgtcagggaaatatttgacaaggcacgacaagctgccccctgtgtactcttctttgatgagttagattcaattgccaaggctcgtggtggtaatattggagatggtggtggagctgcagaccgagtcatcaatcagatcctgacagaaatggatggcatgtccacaaaaaagaatgtgtttatcattggagctaccaaccggcctgacatcattgatcctgctatcctaagacctggccgtcttgatcagctcatttatatcccacttcctgatgagaagtcccgtgttgccatcctaaaagccaatctgcgaaaatccccagttgccaaggatgtggatttggagttcttggctaagatgactaatggcttttctggagctgacctgacagaaatttgccaacgtgcttgtaaactagccattcgtgaatctatcgagagtgagattaggcgagaacgagagaggcagacaaatccatcagctatggaagtagaagaggatgatccagtgcctgagatccgcagagatcactttgaggaagccatgcgttttgcccgacgttctgtcagtgataatgacattcggaagtatgaaatgtttgcccagacactgcagcaaagtcgaggttttggcagcttcagattcccttcagggaaccagggtggagctggcccaagtcagggcagtggaggtggcacaggtggcaatgtgtacacagaagacaatgacgatgacctctatggctaagtgatgtgccagcatgcagcgagctggcctggctggaccttgttccctgggggtgggggcgctcgcccaatgggaaccaggggtgtgcccatggcctgttccattcctcagtccgaacagttcagccccagtcagactctggacgggggttttctgttgcaaaaaaattacaaaagcgataaaataaaagtgattttcatttggga

SEQ ID NO: 4072 - DNA, 794 bp, Rattus norvegicus
  Genbank Accession No. NM_053867
ccgcaccgctccgcgtgcaccgcactcgctccgactgtcaggctagcgccactgtccccagccgtcaccatgatcatctaccgggacctcatcagccatgacgagctgttctccgacatctacaagatccgggagatcgcggacgggctgtgcctggaggtggagggcaagatggtcagtagaacagagggtgccatcgatgattcactcattggtggaaatgcttccgctgaaggtccggagggcgaaggtaccgaaagcacagtagtcaccggtgttgacattgtcatgaaccatcacttacaagaaaccagcttcacaaaagaggcctacaaaaagtatatcaaagactacatgaaatcactcaagggcaaacttgaagaacagaaaccagaaagggtaaagccttttatgactggagctgcagagcaaattaagcacatccttgctaatttcaataactaccagttttttattggtgaaaacatgaatccagatggcatggttgctctactggactaccgtgaagatggtgtgactccattcatgattttctttaaggatggcttagagatggaaaaatgttaacaaattggatctatcgcctgtcaccataattggctgctgcttaccatccatacaacaccaggacttaggacaaatgggactgatatcatcttgagcttttattttgaccgtgatttatttggagtggaggcattgtttttttttttttttaaagaaaaaaaaacatgtcatgtgggttgtctaaaaataaagtgcatttaaattca

SEQ ID NO: 4073 - DNA, 2104 bp, Rattus norvegicus
  Genbank Accession No. NM_053883
gcacgagacggggttggatctgaggtgcagcctcagagggattaggagctgctagacttttttcttttttcctttttctcctctcagtggcacggagtccgaattaattggatttcattcactgggtaggaacaaaactgggcactttcattcagagagattcattgactctgagagtgatctggtgcagagggaccaccggcttggcttctgtcgccttccctaaccgctagcttcggcttgggaaaggccgaatcaaacccggctccgagagccggagcttctcacggcttgcttggcctatgcctgcctcgaggggcgtctgctaggcaccccgccttctcctgcagctcgacccccatgatagatacgctcagacccgtgcccttcgcgtcggaaatggcgatcagcaagacggtggcgtggctcaacgagcagctggagctgggcaacgaacagctgctgctgatggactgccgaccgcaggagctgtacgagtcgtcgcacatcgaatctgccatcaacgtggccatcccgggcatcatgctgcggcgtctgcagaagggcaacctgccggtgcgcgcgctattcacgcgctgcgaggaccgggaccgctttaccaggcgctgcggcaccgacaccgtggtgctctacgacgagaacagcagcgactggaatgagaacacaggtggagagtcggtcctcgggctgctgctcaagaaactcaaagacgagggctgccgggcgttctaccttgaaggtggcttcagtaagttccaggccgagttcgccctgcactgcgagaccaatctagacggctcgtgcagcagcagctccccgcccttgccagtgctgggactcgggggcctgaggatcagctccgactcttcctcggacattgagtctgaccttgaccgagaccccaatagtgcaacggactccgatggcagcccgctgtccaacagccagccttccttcccggtggagattttgcccttcctttacctgggctgtgccaaggactctactaacttggacgtgttggaagagtttggcatcaagtacatcttgaacgtcacccccaatctgcccaatctgtttgagaatgcaggggagttcaagtacaagcaaattcctatctctgatcactggagccaaaacctgtcccagtttttccctgaggccatttctttcatagatgaagcccgaggcaaaaactgtggtgtcctggtgcattgcttggcgggcatcagccgctccgtcacggtgacagtggcttaccttatgcagaagctcaacttgtccatgaacgatgcttatgacattgtcaaaatgaagaagtccaacatctctcccaacttcaacttcatgggccagctgcttgactttgaaaggaccctgggactcagcagcccctgtgacaatcgtgtccccgcacagcagctctacttcaccgcgccctccaaccagaatgtctaccaagtggactccctgcaatctacgtgaaaggcacccacctttcctagccgggagtgtctcattccttcagtttctcttgggcagcatcgaccaggctgctttctttgtgtgtggccccaggtgtcaaaaatgtcaccagctgtctgtattagacaaggttgccaagtgcaaaattggttattacggagggagagatttgctccattcattgttttttggaaggacagggtatgctgtctagatccaggcaataggtttgcttttgtaccccagcctacccaagcagggactggacctccatccagatagagggtaggacaaaggagccggggataggagcatgtgttccttagggccacatatggctgtttcctgttgcatctggaaccaactatattgtcttcagtgaagactgattcaactttgcgtatagtggagccaaagagattttagctctgtatttgtggtatcggttttgaaaacaaaagaactgatcctttaatttgattattgtaaatatttgatcttcacttgagagtgtttgtttggcttgtgtttggtttttaatctttgggtttaaacgagatccaaagggagaaagagcagtatgcctcgtgccgaattc

SEQ ID NO: 4074 - DNA, 667 bp, Rattus norvegicus
  Genbank Accession No. NM_053884
ggcacgaggggcatcactgctgtttggggagccttctgccgggccgacaggatggcgggcaggggtaaactaatcgcagtgattggagacgaggacacggtgactggtttcctgttgggcggcataggggagcttaacaagaaccgccaccctaatttcctggtagtggagaaggataccaccatcaatgaaatcgaagacactttcaggcagtttctaaacagggatgacatcggcatcattctcatcaaccagtacatcgcagagatggttcggcacgccctcgatgcccaccagaggtccattccagccgtcctggagatcccgtccaaggagcatccctacgacgcagccaaagactccatcctgcgcagggccaagggcatgttcactgctgaagacctgcgctagggctgctcagcccttaaccctcctctcgcttccaggcctctcccagtttgccaccctctatttaagtttcaagccttggtttccagcccctcccttcctcttcactgagtggttcctaagctgttggggttctgatgttcaggtccaggctgggtagggaaagaaaggccaaccatctctccactacctatgccattgagcagtatcattgttaacattaaaggaatattctctccgaaaaaaaaaaaaaaaaaaa

SEQ ID NO: 4075 - DNA, 1744 bp, Rattus norvegicus
  Genbank Accession No. NM_053886
agaatccaagatggcggtgtccaggcggcggggtccccaggctggagcgcagtcgttcttctgcgccctgctgctgtctttcagccaattcgtcgggagcgacggcatgggaggagatgctgcggctcccggcgccgcaggcacccaggccgagttgccacaccgccgtttcgagtacaaatacagctttaaggggccgcatctggtgcagagcgatgggaccgtgcccttttgggcccacgcggggaatgctattccaagtgcagatcagatccgaatagcaccgtccttaaagagccaaagaggttccgtgtggaccaaaacaaaagcagccttcgagaactgggaagtggaagtgacattccgagtgaccggaagaggtcgaattggagctgatggcttagcaatttggtatacagaaaaccaaggcttggacggccctgtgtttggatcagctgatatgtggaatggtgttggaatattttttgattcttttgacaatgacggaaagaaaaacaatcctgctatagtagttgtaggcaacaatggacaaatcaattatgaccaccaaaatgatggtgccactcaagccttagcgagttgtcagagggacttccgtaataaaccctatcctgtccgggcaaagattacctattaccagaaaacactgacggtcatgatcaataatggctttacaccagataaaaatgattatgaattctgtgccaaagtggaaaatatggttatccccacgcaagggcattttgggatatctgctgcaacaggaggtcttgcagatgaccacgatgttctctctttcctgactttccaactaaccgagcccggaaaagagccacctacgccagaaaaagacatttcagaaaaagaaaaggaaaagtatcaagaggagtttgaacacttccagcaagaattagacaagaagaaggaggaattccagaagggccaccctgacctccaggggcagccagcggatgacatctttgagagcataggggatcgggagctgagacaagtgtttgaaggacaaaatcgcattcatctggagatcaagcaacttaaccggcagctggatatgattctcgatgaacagaggagatacgtgtcttctctgacagaggagatttccaggagaggagcagggaccccaggacagcctgggcaggtctcccaacaggaactggacactgttgtgaggacccagctggagattttgagacaagtgaatgagatgaagaactccatgcgtgagaccatgcggctggttagtggcgtccagcacccaggctcggccggcgtctacgagacaacccagcacttcatggacatcaaggagcacctgcacatcgtgaagagagatatcgacagcctcgcgcagcgcagcatgtcatctaatgaaaaaccaaaatgcccagatctaccagcattcccgtcgtgtctgtccacagtccactttgtgatatttatagtggtgcagacggtgttgttcattggctacatcatgtacaggactcagcaagaagcagctgccaaaaaattcttctgaccttgattttcctatgtgtacgtcatgtatctgggctagactttcgctggcttcaagacaatttacctcttattaaagtaatggtctcgtttgctttgggatccagaacaacactgtttagtatatatgctactaaattgttgtaagcctttgtaagtttcctctcagatgtcatttggg

SEQ ID NO: 4076 - DNA, 5180 bp, Rattus norvegicus
  Genbank Accession No. NM_053887
gaattccgcacccggggcgggacaagaggtctgctttccaaagagaaggcttcgcgtctgtctgcagcaggcgacagtcccgggcgccacctgcgcttcgggcgcgggccaggctggtgcgcgccgggcccccagcgcccgctactgagagcgtgaagtgaccgaccgtgagtcctccggcttgcgtccccttccagcaccagggactcacgccccaattactgcttgctcaagggtggacgagctccggccgagccgctgccccgccccgtactacctggcagctgcccgggtgcagcgcacagcgccccgcgcggccccagcagagcccctgccctcccacctgcgccgcgcgcccgccgctccgtgctcccgagacaggagacgcggccccgctcccgctcgcgcccgcgcactcggcgcagcgcgcgcgcccgccgctccgcccgccccccgcgctctccccgccccctccctcccccgcaggcacgagcgaatgtagcccgcgagagaaaatggcggcggcggcgggcgatcgcgcctcgtcgtcgggattcccgggcgccgcggcggcgagccccgaggcgggcggcggcggcggagctctccagggaagcggcgcgcccgcagcgggcgcggggctgctgcgggagactggcagcgcgggccgcgagcgcgcggactggcggcggcagcagctgcgcaaagtaaggagtgtggagctggaccagctgccggagcagccgctcttcctcaccgcctcgccgccctgcccatctacttccccgtcgccggagcccgcggacgcggctgcaggagcgagtggcttccagcctgcggcgggaccgccacccccgggagcagcgagtcgctgcggctcccactctgccgagctggcggccgcgcgggacagcggcgcccggagccccgcgggggccgagccgccctctgcagcggccccctccggtcgagagatggagaataaagaaaccctcaaaggattgcacaagatggatgaccgcccagaggagcgaatgatcagggagaagctcaaggcgacctgtatgcctgcctggaagcacgagtggttagaaaggaggaacaggagaggccctgtggtggtgaaaccaatccctattaaaggagatggatctgaaatgagtaacttggcagctgagctccaaggagagggccaggcaggctctgctgcaccagctcccaagggccgacgaagcccgtctcctggaagctccccatcagggcgctcagggaagccggaatccccaggagtgagacggaaacgagtgtccccagtgcctttccagagtggcagaatcacaccacctcgaagagccccgtcgccagatggcttctcaccgtacagcccagaggagacgagccgccgtgtgaacaaagtgatgagggccaggctgtacctcctgcagcagataggacccaactctttcctgattggaggagacagtccagacaataaataccgcgtgtttattgggccacagaactgcagctgtgggcgtgggacattctgcattcacctcttgtttgtcatgctccgggtgttccagctagaaccctccgaccccatgctatggagaaaaactttaaaaaattttgaggttgagagtttgttccagaaataccacagtaggcgtagctcaagaatcaaagctccatctcggaacaccatccagaagtttgtctcacgcatgtcaaactgtcacacattgtcatcgtctagcacatccacatctagttcagaaaacagcatcaaggatgaagaggagcagatgtgtcccatctgcttgttgggcatgctggatgaggagagcctgactgtgtgtgaagacggctgcaggaacaagctgcaccaccactgcatgtcaatctgggcagaagaatgtagaagaaatagagaaccgttaatatgtcccctttgtagatctaagtggagatcccatgacttctacagccatgagttatcaagccctgtggattcccctacctccctgcgaggtgtacagcagccctcctccccgcaacagcctgtggccggatcacagcggaggaatcaggaaagcaattttaaccttactcattatggaacccagcagattcctcccgcttacaaagatttagccgagccatggattcaggcattcggaatggagctcgttggctgcttattctctagaaactggaacgtaagggagatggcccttaggcgcctttcccacgatgttagcggggccctgttgttggcgaacggggagagcactggaacttctggaggcggcagcggaggcagcctaagtgctggcgccgccagtgggtcttcccagcccagcatctcaggggacgtggtggaggcgttctgcagcgtcctgtctatcgtgtgcgctgaccctgtctacaaagtgtacgttgctgctttaaaaacactgagagccatgctggtatacactccttgccacagcctggcagaaagaatcaaacttcagagacttctccggccagtggtagacaccatcctagtgaagtgcgcagacgccaatagccgcacgagtcagctgtccatatcaacactgttggagctctgcaagggccaagcgggggagttggcagttggacgagaaatacttaaagctggatccatcggtgttggtggcgttgattacgtcttaagttgtattcttggaaaccaagctgaatcaaacaactggcaagaactcctgggtcgcctctgtcttatagacagattgctcttggaaatttctgcggaattttatcctcatattgtcagtaccgatgtctcacaagccgagcctgttgaaatcaggtataagaagctgctgtccctcttagcctttgccttgcaatccattgacaattcccactctatggtcggcaaactctcgcggaggatttatctgagctcagcacgaatggtgaccacagtgccccccctgttttccaagctggtaaccatgctaagtgcttctggatcctcccacttcgccaggatgcgccggcgtctgatggccattgcagacgaggtagaaattgccgaggtcatccagctgggttcggaagacactttggatggccagcaggacagctcgcaggcattggcccctccccgctatccagagagcagctcccttgagcacacagcccatgtagagaaaactggaaaaggattaaaagctacgagactgagtgccagctcagaggacatttctgacagactggctggcgtttctgtaggacttcctagttcagcaacaacagaacaaccaaagccaacagttcaaacaaaaggcagaccccacagtcagtgtttgaactcctctcctttgtctcctcctcagttaatgtttccagcaatatcagccccatgttcatctgccccgtctgtcccagctggctctgtaacagatgcttctaagcatagacctcgggcgtttgttccctgtaaaataccctctgcgtctccccaaacacagcgcaagttttccctacagttccagaggacctgctctgagaaccgagactcagaaaaactctccccagtctttactcagtcgagacccccaccctccagtaacatacacagggcaaaggcatcccgacccgttccgggtagcacaagcaaactaggggatgcctcaaaaaacagcatgacactcgacctgaacagtgcttcccagtgtgatgacagctttggcagtggcagcaacagtggcagcgccgtcatacccagtgaggagacggcattcaccccagcagaggacaagtgcaggttagatgtcaaccccgagctcaactccagtatcgaggaccttcttgaagcatctatgccttcaagtgacacaacagtcactttcaagtccgaagtcgccgtcctctctcctgagaaggccgaaagtgatgacacctacaaagatgacgtcaatcacaatcaaaagtgcaaagagaagatggaggctgaggaagaggaggcgctcgcgattgccatggcaatgtcggcttctcaggacgccctccccatagtccctcagctgcaggtggaaaatggagaggatatcatcatcatccagcaggatacaccagaaaccctaccagggcataccaaagcgaacgagccctacagagaagacaccgagtggctgaaagggcagcagataggcctcggagcattttcttcttgttaccaagcacaggatgtgggcactggaactttaatggctgtgaaacaggtgacctacgtcagaaacacatcttctgagcaggaggaagtggtggaagccttgagggaagagatcaggatgatgagccacctcaaccatccgaacatcatcaggatgctgggggccacgtgcgagaagagcaactacaacctcttcatcgagtggatggcgggagcctccgtggctcacctcttgagtaaatatggagctttcaaggagtcagtggtcattaactacacagagcagttactccgtggcctttcctatctccacgagaaccagatcattcacagagacgtcaaaggggccaatctgctcattgacagcaccggtcagcggctgagaattgcagacttcggtgctgccgccaggttggcatccaaaggaactggtgcaggagagttccagggacagttactggggacaattgcattcatggcgcctgaggtactaagaggtcagcagtacggtaggagctgtgacgtctggagtgttggctgcgccattatagaaatggcctgtgcaaaaccaccctggaacgcagaaaagcactccaatcatcttgctttgatatttaagattgcgagtgcaactactgcaccatccatcccgtcacacctgtccccgggcctgcgagacgtggctctgcgctgtttagaacttcaacctcaggacagacctccgtcaagagagctactgaagcatcctgtcttccgtacaacatggtagtcaactgctcagggtgcgcaacaaggaaagaaaactcgcgggcagccacgttgatagtctgctggcctcataccactgaccagaagaggggccagtggggagcccgcacctaagcatgtgactgacaaatcatgactgcacctgagctccgtctgcagacggctacaactcgtgcaggagctg

SEQ ID NO: 4077 - DNA, 1208 bp, Rattus norvegicus
  Genbank Accession No. NM_053891
gaattccgccccgcccgggctgagaaccatcttgttttccacgcagatccgcagggctacacgcgtcgtgtcccgggagcgcctcctttctcctcgcggccgctacaggcttggtaagcctttttctccctccggccggcaggctgggcgcgcaggggtgccggcccctgccgggcgcgcagtggcaccatgggcacggtgctgtccctgtcccccagctatcgaaaggccacactgtttgaggatggcgcggccaccgtgggccactacacggccgtgcagaacagcaagaacgccaaggacaagaacctgaagcggcactccatcatctcggtactgccttggaagaggatcgtggcggtgtcagcgaagaagaagaactccaagaaggcgcagcccaacagcagctaccagagcaacatcgcccacctcaacaatgagaacctgaagaagtcgctgtcgtgtgccaacctgtccacgttcgcccagcccccgccggcccagccgcccgcacccccagccagccagctttctggctcccagactggggtctcctcttctgtcaagaaggccccgcaccctgccatcacctccgcaggaacacccaaacgggtcatcgtccaggcgtccactagtgagctgctgcgctgcctgggtgagtttctctgccgccggtgctaccgcctgaagcacttgtccccaacggaccccgtgctctggctgcgcagcgtggaccgctccctgcttctgcagggatggcaggaccagggtttcatcacaccggccaatgtggtcttcctctacatgctctgcagggatgttatctcctctgaggtgggctcggaccacgagctccaggctgtcctgctgacctgtctgtacctctcctattcctacatgggcaatgaaatctcctacccgctcaagcccttcctggtggagagctgcaaggaagccttttgggaccgttgcctctcagttatcaacctcatgagctccaagatgctgcagatcaatgctgacccacactatttcacacaagtgttctctgacttgaagaatgagagtggtcaggaggacaagaagcgactcctcctggggctcgatcggtgagccccctgtagctggtatcctggctcaaggattccattcgtttttaaaatttattattaaagaatcaagtttgtgtacagtatgtgtctagcaga

SEQ ID NO: 4078 - DNA, 3273 bp, Rattus norvegicus
  Genbank Accession No. NM_053892
gaattcggcacgagcttatctggcctccttgagtgttcccggcttctgtcctttgatcccctggcgtccccaactcccatccggtgaccgattcttctccgttgccgccctcagtttccctaacttcctaaatcaacccatcccccaatcattgcccgactttcaccctggacggtccactgtccccagctcctccctctgcgcttctgagtggccctgattttctgcctcattgcccgatttcccccccaacaccacctgtttcctgcgtccctccctttatgcccaccccccaacgcccatttctaactctctgcttatcttgtgcctccgcgtttcttctgctcccacgtgttttctagcgtccagtcctgggttcacctctagctcccacagatgacctggaagctggtggcagggagctgtgacccagagcacaggggcaggctgggtcgcctacctgtcccacataggatgcagttctttggacgcctcgttaacaccctcagtagtgtcaccaacttgttctcaaacccattccgggcaaaggaggtgtccttggctgactatgcctcaagtgaacgtgttcgagaggaagggcagctgatcctgttgcagaatgcttccaatcgtacctgggactgtgatctggtcagccctaggaacccacagagtgacttccgactcttccaactggagtcagaggcagacgtcctggtgaacttccagcagtattcctcccagctgccaccgttctatgagagctctgagcaggtcctgcatgtggaggtgctgcagctgacggacctcattcggaaccaccccagctggacagtgacgcacctggccgtggaacttggcattcgggagtgtttccatcacagccgcatcatcacgtgcgccaacagcacagagaatgaggagggctgtaccccactacatctggcctgccgcaagggtgacagtgagattctggtggagttggtacagtactgccacgcccagatggatgtcactgacaacaaaggagagaccgccttccattacgctgtgcaaggggacaatccccaggtgctacagctcctaggaaagaatgcctcagccggcctgaaccaggtgaacaaccaagggctgacgccgctgcacctggcctgccagatggggaagcaggagatggtgcgtgtcctgctgctctgcaatgcccgctgcaacatcatggggcccggtggcttccccatccacacagccatgaagttttcccagaaggggtgtgctgaaatgattatcagcatggacagtaaccagatccacagcaaggatcctcgctatggagccagcccgctccactgggccaagaacgctgagatggcccgaatgcttctgaagaggggctgtgacgtggacagcacaagtgcctcggggaacacagccctgcacgtggctgtgacgcgcaaccggtttgactgtgtcatggtgctgctgacctatggggccaacgcaggtgcccgaggagagcatgggaacacaccactgcatctggccatgtcgaaagataacatggagatggtcaaagccctcattgtatttggggcagaagtagacaccccgaatgactttggggagactcctgcattcatagcttccaagatcagcaagcagcttcaggacctcatgcccgtctcccgagcccggaagccagcgttcatcctgagctccatgagggatgagaagcgaacgcatgaccacctgctctgcttggacggagggggcgtgaagggcctggtcatcatccagcttctcattgccattgagaaggcctcaggtgtggctaccaaggacctcttcgactgggtggcaggaaccagcacaggcggcatcctggccctggccattctacacagtaaatccatggcctatatgcgtggcgtgtacttccgtatgaaggatgaggtgtttcggggctcacggccctatgagtctgggcccctggaggagttcctgaagcgtgagtttggggagcacaccaagatgacagatgtcaagaaacccaaggtgatgctgacagggacactgtcagaccggcagccagcagagctccacctcttccggaattacgatgccccagaggccgttcgggaacctcgctgtaccccaaacattaacctgaagccgcccacccagcctgcagaccagttagtatggcgggcagcccggagcagtggggcagccccaacctatttccggcccaatggacgcttcttggatggtgggctgctggccaacaaccccacactggatgccatgactgaaatccatgagtacaatcaggatatgatccgcaagggccagggcaacaaggtgaagaaactctccatagtcgtgtctctgggtacaggaaagtcccctcaagtgcctgtaacctgtgtagatgtctttcgtcccagcaacccttgggaactggccaagactgtttttggagccaaggaactgggcaagatggtggtggactgttgcacagatccagatgggcgggctgtggatcgtgcccgggcctggtgtgagatggtcggtatccagtacttcaggctgaacccccagctaggctcagacatcatgctggacgaggtcagtgatgcagtgctggtcaacgccctctgggagaccgaggtctacatctatgagtaccgggaggagttccagaagcttgtccagctgctgctatctccctgagcccggcctgctggcaggagtggccggcgtggcacactgcggccaggctggcctgccgctccatgtccatctgagactagggctcggagcgggcagttccccatgaggtacctctcctgatccatccgcactttactaatccagctgaaagcccagagttccctcggccccttcccctgactatgaaggacaactgattccatctactacccatatatcagagatcaacactaagggccagtgtcgagagggccctcccaggctccctggccactgctgcccaccccctctcccacttcctgatgtcagggattagagaaatgttccaccccgtcatcaggtgaaatccaggctaatgaaacccagcgccattctgccattcgactttgcccctcgcacctgcagcctctccaccctgcagccgccccacaaggagcgctcctagctcccaaaggtcaatcctgtgcacatgctcttctctggaaggagagtggggagggctcaaggccacctcaactgtgaaataaacggttttacactcaa

SEQ ID NO: 4079 - DNA, 1780 bp, Rattus norvegicus
  Genbank Accession No. NM_053895
cgcgcgggcaggtctatggggagggacgaggagtcccactctctctgcggcaacggttggctgagaaagggtcatgacgtcacacagggccctcgaagagggcaggtgagtggctagagtagtgagcaccaaacagcagtgacgttgggttcagaccccgcccctttccttggagcgcggagactcgctacggaagcttcggccaatcagaaggaagacccaaggatgatatggtgatggcatgcagccagaggtaaaatgacaaggtgacttattcgacatgtcaaaatcttgtttccagagctctctgactgctctcacgtactcaaaaatagtggggacagagccgacctggggaggcttggcttcaagagacgctagattataaagaaagccaggagtcccggtcgccaaaatggggaggagccagtgaagaaacgggcccagtttcctctttaagacccaccccagagcgctggccccgcctcacgccgttgctgctgcgacccgcccccttccactcgcccccgggctgggctggggctcccggttccgcgcccctggctacgggggtacggccccctagccaccactacttggggccttctgctcaagatccctccaggcactgcggatggaggcgtgggggagccttggaacctcagactagttttgaatccctgccctgccagtcactagcttgtggctttgagtctgacaagatgtaccaggtcccattgacactggaccgggatgggaccctagtccggctccgcttcactatggtggccctgatcacggtctgctgtccacttgtcgccttcttcttctgcatcctgtggtccctgctcttccacttcaaggagacaacatctacacactgtggggtgcccaattacctgccatcagtgagctctgccattggtggggaggttccccagcgctacgtgtggcgtttctgcattggcctgcactcggcaccccgcttcttgacagccttcgcctattggaaccactacctcagctgtgcatccccgtgcccgggttaccgccttctctgccgcctcaacttcagtctcaatgtggtggagaacctggcactgctcgtgctcacctatgtctcctcctccgaggacttcaccatccatgaaaatgctttcattgtgtttatcgcggcctccctcagttacatgctcctcacctgcattctctggcggctgaccaagaagcacacagatcgcaagtcctacagctggaaacaacggctcttcatcatcaacttcatctccttcttctcggcgctggctgtttacttccggcacaacatgtattgtgaggctggagtgtacaccatctttgccatcctggagtacactgtggtcctaaccaacatggcgttccacatgacagcctggtgggacttcgggaacaaagagctgctaataacctctcagcctgggaaaagagattctaaaccccgtctctgatcctggaaaacaagaaaccactctggccttccctatctcagtgtcctctctgggcccttctccgtctggggactgggagagaagagcaggaagggtaggacaaggctgaccccagcactgctgacttctccccccctctcatctctcatgggggtcttcaagaagcatcactactcactgaaaggtcctaaaaagctgagctggcaggaaagccctaccacttggtgctaagaaaaaaaaaaaaaaaaaaaaaaaaaaaaaaaaaaaaaaaaaaaaaaaaaaaaaaaaaaaaa

SEQ ID NO: 4080 - DNA, 1765 bp, Rattus norvegicus
  Genbank Accession No. NM_053902
ttgaaaaggtactggaaactgaggaccctatctggatcaaagcagtttctgatggagccctcgcctcttgagctaccagttgatgcagtgcggcgcatcgcggctgaactcaattgtgacccaaccgatgagagggtggctctccgcttggatgaggaagataaactgaagcgttttaaggactgtttttatatccccaaaatgcgggacctgccttcaattgatctatctttagtgaatgaggatgataatgccatctatttcctgggaaattcccttggtcttcaaccgaagatggttaaaacatacctggaggaagagctagataagtgggccaaaataggagcctatggccatgaggtagggaaacgtccttggattataggagatgagagcattgtaacccttatgaaggacattgtaggagcccatgagaaagaaatagctctaatgaatgctttgactgttaatttacatctcctgctgttatcattctttaagcctacaccaaagcggcacaaaattcttctagaagccaaagccttcccttctgatcattatgcgatcgagtcacagattcaacttcatggacttgatgttgagaaaagtatgcggatgataaagccacgagagggggaagagaccttaagaatggaggacatactggaagtaattgagaaggaaggagactcaattgctgtggtcctgttcagtggcctgcacttttatactggacagctgttcaacattcctgccattacacaagccggacatgcaaagggctgttttgttggctttgacctagcgcatgcggttggaaatgttgaactccacttacatgactgggatgttgactttgcctgctggtgctcctacaagtatttaaattcaggagctggaggtctggctggtgccttcatccatgagaaacacgctcacacgatcaagccagcgttagtgggatggttcggccatgaactcagtacaagatttaacatggataacaaactacaattaatccccggggtcaatggattccgaatttccaaccctcccattctgttggtctgctccttgcatgccagtttagagatctttcagcaagcaactatgactgcgctgaggagaaaatccattctgctgacaggttatctggaatacttgctcaaacattaccatggcggaaatgacacagaaaacaagaggccagttgtgaacataatcaccccatccagagcagaggaacgaggctgccagctgacactgaccttttccatttccaagaaaggcgtttttaaggaactagaaaaaagaggagtcgtctgtgacaagcgagaaccagaaggcatccgggtggccccggttcctctctataattctttccatgatgtttataagttcatcagactgcttactgccatactcgactctacagaaagaaactagccatgctttctaaataactcaagtaaatctcacacactgggggttccacttctactgcattttagtcattcaaaagtctccagaaattgatggcatagaaatgatgatgattttataaacttacataaaacctggtacatgttttaatatctgtgtcgctgatgtgctgtggactaagaagtcacattttacatgactccaacctacagatgactgtcttgatcagctgtcaccttccatggtcactgaaaggttgtgtgtttaatttgtgactgaaatgacaacattaaaatgtatctggacttcttgtataaaaaaa

SEQ ID NO: 4081 - DNA, 1428 bp, Rattus norvegicus
  Genbank Accession No. NM_053906
ctgtttctgctacttgctctttgtttcaaactgccttggagagtttctcacagtaccgtgtgcttcttgctaacttccggtttaagctttagtcgttctctagtctcttcagttttcaccctgagcctcgacactggactactgaaatcgtgtagtgaacgttggatgtgtcccaaaaaggtaatgtggaacacagccgtgcactcggaattcatacatgatcacgtggattacggctttcaaaactgcaagagtaaattcaattggcatgtcatcaaggagaagcgggatgcttacgtgagccgcctgaacaacatctaccaaaacaatttaaccaagtcccacatcgaagtcatccacggctacgcaacatttcgagatggtccccagcccacagcggaagtcaacgggaagaagttcactgctccgcacatcctgatcgccacgggtggtgtgcccacggttcctcatgagaaccagatcccaggtgccagcctggggataaccagtgatgggttctttcagctggaagacttgcccagccgcagcgttattgtgggtgccggttacattgccgtggagattgcgggcatcctctccgccctgggctccaagacgtctcttatgatcaggcatgataaggtgcttagaagctttgattcactcatcagttccaactgcaccgaggagctggagaacgctggcggtgttgaggttctcacagttaagaagttctcacaggttaaggaagtaaagaagacctcatcgggcttggaactccatgtggttactgcacttcccggtaggaaacccaccgtgaccacgattccagatgtcgattgcctgctctgggccattggacgggacccaaactctaagggcctgaatctaaataaactggggatacagactgatgacaaaggccatatcctagtggacgagttccagaataccaatgtcaaaggcgtctatgccgtgggcgatgtctgtgggaaagcacttctcaccccagttgcgatcgctgctggccggaaactcgcccatagactttttgagggcaaagaagattccaggttggactatgacaacatccctaccgtggtcttcagccacccgcctatcgggacagtggggctcactgaagatgaagccgtccataagtatggcaaagacaatgtgaaaatctactcgaccgccttcaccccgatgtatcacgctgtgaccacgaggaagacgaaatgcgtgatgaagatggtttgtgccaacaaagaggagaaggtggttggcatccatatgcaggggattggctgcgatgagatgcttcagggcttcgctgtagcagtgaaaatgggggccaccaaggccgacttcgacaatagggtcgccattcatcctacctcttcagaggagctggtcacacttcgttga

SEQ ID NO: 4082 - DNA, 1561 bp, Rattus norvegicus
  Genbank Accession No. NM_053911
gcgggccccaccggccgggcggttgggccgtgaagggagagtcttttcggcgctgaggacgggcgctgaggaggcggcggtggctcctggggcgtttgagcgggctcactcgagcccgcgggccgacgcggacgcaggcccagccggcggaaacgccccggactccccgcgggccttcctagccgccatggaggacggtgtctacgagcccccagacttgactccagaggagcgcatggagctggagaacatccgtcggcgaaagcaggagctgctggtggagatccagcgcctccgggaagagctaagtgaagctatgagcgaagtggagggtctggaggccaatgagggcagtaagaccttgcagcggaaccggaagatggcaatgggccggaagaaattcaacatggaccccaaaaaggggatccaattcttggtggagcatgaacttctacagaacacacctgaggaaattgcccgcttcctgtacaagggcgaggggctgaacaagacagccattggggactacctaggggaaagggaagagctgaacctgtctgtgctccatgcttttgtggatctacatgagttcaccgacctcaatctggttcaggccctccggcaattcctgtggagctttcgcctccctggagaggctcagaaaattgaccgaatgatggaggcctttgcccagagatattgcttatgtaatcccggggtcttccagtccacagacacctgctacgtgttgtccttcgctgtgatcatgctgaacaccagccttcacaatcccaatgtcagggacaagccgggcctggagcgctttgtggccatgaaccgaggcatcaatgagggtggggacctgcctgaggaccttctcaggaacctctatgacagcatccgaaacgagcccttcaaaatccctgaggatgatgggaatgatctcacccacaccttcttcaacccagaccgagagggctggctcctaaagctgggagggggccgggtgaagacttggaagcgtcgctggttcatcctcacagacaactgcctctactactttgagtacactacggacaaggagcccagagggatcatccccctagagaacctgagcattcgtgaggtggatgatcctcggaagccgaactgctttgagctttacattcccaacaataagggacagctcatcaaagcctgcaaaacggaggctgatggtcgggtagtagaggggaaccacatggtgtaccgaatctcagcacccacacaggaggagaaagacgagtggatcaagtccatccaggctgctgtaagcgtggaccccttctacgagatgttggcagcaagaaagaagcggatttctgtgaagaagaagcaagaacaaccctgaccctgtccccaactccattatttattttggagctgccccgcctgggtggcaggacccctgggccctggggctgtggatcctggttccctgtttggaaaatcaccacctctagctcctgactccttatttgtaattaacatgttggtaatcttattaattatttaacccctc

SEQ ID NO: 4083 - DNA, 2347 bp, Rattus norvegicus
  Genbank Accession No. NM_053921
ggagcttctgtttccgggtacggtttctgtcacaaagccgagccctcctttcgcaggtggcgtcacgggtcctctgctccgtgcccgaggtcagcaagcaaggacgggcgcttcccagccagccaccggagccgggcctcgcagctctgggactgcagctcgagcgacacgttccttggcccacacctatctccgagtcacgctctgccctgtgaggtgccatgcagaaggactaagactcagcacccgtttgatacaaaacaagttcatgctccctagagtgttcgtgggaaaagtaaatcccagtacacacaagacactatggctgagcatggggctcatatcacaactgcttcggtggcggacgaccagccatccatctttgaggtggtagcacaggacagtttaatgacagcagtgagacccgctcttcagcatgtggtcaaggttcttgcagaatcaaatcctgcgcactatggcttcttttggaggtggtttgatgaaatcttcactctgctagactttctgctccagcagcattatctttctagaactagtgcctcattttctgaacacttttatgggttaaagcggattgtagcggggagctcgccgcagcttcagagaccagccagtgctggcctccccaaggaacacctctggaaatccgctatgttccttgttcttcttccctatctgaaagtgaagctggagaagctggcttctaccttgagagaagaagacgaatactctattcaccccccttcttctcactggaaacgattctacagagtcttcctggctgcctacccgtttgttaccatgacctgggaaggctggttccttacacaacaacttcggtacatattgggaaaagctgagcatcactctcccctgctgaaactggctggagttcggctaggtcgactgacagctcaggacatacaagctatggaacacagactggttgaagccagtgcaatgcaggagcccgtcagaagcattggtaagaagataaagtcagcactgaagaaagctgtgggaggtgttgccttatccctctctactggcctctctgtgggtgtattcttcctgcagtttcttgactggtggtactcttctgagaaccaagagaccatcaagtcactgactgccctgcccactccaccaccacctgtgcacctcgactacaactctgattctcccctcttacccaaaatgaaaacagtgtgcccactgtgtcgtaaagctcgggtcaatgatacggttcttgccacctctggctatgtattctgttaccgctgtgtgtttaattatgtgagaagtcaccaagcctgtcccattacagggtatccaacggaagtccagcatctaattaaactctactctccagagaactgaaagagagattagtgtattctctcacagctcaagttctatactataggaccacaagatggttttagtatggcaatcaacaatgattcataactacattaacttttagtagttatatggatttctttaaaaggatatatccacttggtcctaaccttatggtttgctctctaccaagctgtttaagcaggagaatcaggattgtaggtggtgtgagggcccatgtggaggtgggttataaaagaccacctcacttaagagtaaggttttaagttgtggtagtgtagtgtcagcactctggagatggaggcgggagtttgagttcaaggccaccaaagggggagtgtcaaaagtaaaatgaaagtaagagactgattaagagggataaaatagcataggaaaccccaggttagatcttacaaagcaagtggtttgggaagcaggccttctctttagaaaacatttctctacttttgaagtagaggctttatcagacacggactttctctttatagaaatatctataaaccctttagagaaaagccccctccatctatcatgacttactaacatctaccacagtttatcagtatttgaagatttccttcatgatccatacctgcctgtctagggaagggtttgtttatggggcggagtctggaaatttcaatatgaataaaaactagcaatggtgagatgcagtaaaatctttatctaatgtttacctgatgcctacctaatagatatctaatgagtaaaagctttctgcttgctcttatgagtttgctcagttgataggaatcatgctaggtattatgaaagtttctatgaaacatttaattaaattttaacaatacatgattctaggaaagaattgttccatgctgtcatgattatgtggaaactcaaaagatcacttcaggagtttaaataaatttttattcagatc

SEQ ID NO: 4084 - DNA, 1219 bp, Rattus norvegicus
  Genbank Accession No. NM_053946
aattgaggaggtcagaaggtttcgcccggtcgccgagagagacaagcgaacatggcctcgccgaggtggctctggtgtgtgtgtgcgaccgcagcggtcacactgctgctcgtttccaaggttccttcggcctctgcccaaagaaagaaggagaaggttttagtggagaaggtcattcagctgatggaatggaccaatcaaagaccagtcataagaatgaatggagacaagttccgtccccttgttaaagcaccaccaagaaattactctgttattgtcatgtttactgctctccaacttcatagacaatgtgtcgtttgcaagcaagctgatgaagaattccagattttggcaaatttttggcgatactccagtgcatttaccaaccgcatattttttgccatggtggattttgatgaaggctctgatgtatttcaaatgctaaacatgaattcagctccaactttcatcaactttcctccaaaaggaaaacccaaaagggctgatacatatgagttgcaggtgcgagggttttcagctgaacagattgcccggtggatcgcagacagaactgacgtcaacattagagtaatcagacctccaaattatgctggacctctaatgttggggttgcttcttgctgttattggtggacttgtgtatctgcgacgaagtaatatggaattcctctttaataaaaccggatgggcttttgcagcattgtgttttgtacttgcaatgacatctggccaaatgtggaaccatataagaggaccaccatatgctcataagaatccccatacaggacatgtgaattatatccacggaagcagccaagcacagtttgtagctgaaacccacattgttcttctcttcaatggtggggttaccttaggtatggtgcttttatgtgaagctgctgcctctgacatggatattgggaagcgaaggatgatgtgtattgctgggattggacttgttgtgttattcttcagttggatgctgtccatctttcgatcaaaataccatggctatccatacagctttctgatgagttaaagaggattccagagaaacattgacaccggtaatggaaactgaaaaataaaacctgttgggggttggagaatgcactcaagttttttcttaccccttgggcaaggaacgacttataacaattaccaagtccggggccttaaagaaaggaacagaggtttgg

SEQ ID NO: 4085 - DNA, 864 bp, Rattus norvegicus
  Genbank Accession No. NM_053948
tgacttctgctagtgcttccggcgaggtcccttcctggggagttctggcctctgcggtccaagcttctgcagaagatgttttatcatatttccctggagcacgagatcctactgcacccacgctactttggtcccaacttgctcaacacggtgaagcagaagctgttcaccgaggtggaggggacctgcactgggaaatatggctttgtgattgctgtcactaccatcgacaatattggtgctggtgtgatccagccgggccgaggttttgttctttatccagtgaaatacaaagctattgttttccggccctttaaaggggaagtggtggatgctgtggtcactcaggtcaacaaggttggacttttcacagaaattgggcccatgtcctgcttcatctctcgacactccatcccttcagagatggagtttgatccaaattcgaaccccccttgttacaagaccatggatgaggacattgtaattcagcaggacgatgagatacgcttgaagattgtagggacacgtgtagacaagaatgacatttttgctattggctctctgatggatgactacttgggacttgtgagctgagtgagggagcctccagcttgctttgatcctgatttagaaagtgtgactttccaacttgaactcagcaccaacttgactgtcgtaccagaggttcaatctggccactgttatgggggcagggaagaaggctccttgtccccagaacactttgtttcttccagctgagctgtgctcttattctcttctgtgttctaaccataaacatgttgtccttagttctcaaggaaatgtgtcttctcttggtaggaataaaagttgtttatttatttt

SEQ ID NO: 4086 - DNA, 3889 bp, Rattus norvegicus
  Genbank Accession No. NM_053949
atgccggtgcggaggggccacgtcgcgccgcagaacaccttcctcgacaccatcatccgcaagtttgagggccagagccgcaagttcatcatcgctaacgctcgtgtagagaactgcgccgtcatctactgcaacgacggcttctgcgaactgtgcggctactctcgggccgaggtgatgcagcggccctgcacctgcgatttcctgcatgggccgcgcacgcagcgccgtgccgccgcgcagatcgcgcaggccctgctgggcgcggaggagcgcaaagtggagatcgccttctaccggaaagatgggagctgcttcctgtgtttggtggatgtggtgcccgtgaagaatgaggatggggctgtcatcatgtttatcctcaactttgaagtggtgatggagaaggacatggtagggtcgccagctcatgacaccaatcacagggggccctctaccagctggctagcttctggccgggccaagaccttccgcctgaagctgcctgccttgttggcactgactgccagggaatcgcccatgcggacaggaagcacgggcagtcctggagcccccggggcagtggtggtggatgtggacctgacgccggcagcacccagcagtgagtccctggccttggatgaggtttctgccatggacaaccatgtggctggacttgggcctgcagaagagaggcgagcactggtgggcccagcgtctgcttcaccggtagccagcatcccaggccctcacccgtcccctcgagctcagagccttaaccctgacgcctctggttccagctgcagtctggcccgaacacgctcacgggagagctgcgctagtgtgcgccgggcgtcttccgcagatgacatcgaggcaatgcgggctggggcgctgcccctcccgccccgacatgctagtacaggggccatgcaccccctgcgcagtggcctgcttaactccacctcagactctgacctcgtgcgctaccgaaccattagcaagataccccaaatcaccctcaactttgtggacctcaaaggcgaccctttcctggcttcacccaccagtgaccgggaaatcatagcacccaagataaaagagcggacccacaatgtcaccgagaaggtcacccaggtcctgtccttgggagccgatgtgcttcctgaatataagctgcaggccccaagaatacaccgctggaccatcctacactacagccccttcaaggcagtgtgggactggctcattctgctgctggtcatctacacagccgtcttcacaccgtactcggctgccttcctgctgaaggagactgaagatgggtcccaagcccctgactgcggctatgcctgccagcctctggctgtagtggacctcctcgtggacatcatgttcattgtggacatccttatcaatttccgcaccacctacgttaacgccaatgaagaggtggtcagccatcctggccgcatcgctgtgcactacttcaagggctggttcctcatcgacatggtggctgccatccccttcgacctgctcatctttggctctggctctgaggagctcatcggactgctgaaaactgccaggctgctgcggctggtgcgagtggctcggaagctggaccgctactcggagtatggggcagcagtgctcttcctgctcatgtgcaccttcgcgctcattgcacactggttggcctgcatctggtacgccatcggcaacatggaacagcctcacatggactcacacattggctggctgcacaacttgggcgaccagatcggcaagccctacaacagcagcggcctgggaggcccctccatcaaggacaagtacgtcacagcgctctacttcaccttcagcagcctcaccagcgtgggctttggcaatgtctctcccaacaccaactcagaaaagatcttctccatctgtgtcatgctcattggctccctcatgtatgccagcatcttcggcaacgtgtccgccatcatccagcggctgtactcgggcacggcccgctaccacacacagatgctccgggtgcgggagtttatccgcttccatcagattcccaacccgctacgccagcgcctcgaggagtacttccagcacgcttggtcctacaccaacggcatcgacatgaatgcggtgctgaagggtttccccgagtgcctgcaggctgacatctgcctacatctaaaccgctcactgctgcagcactgcaaaccattccgaggggccactaaaggctgcctgagggccctggccatgaaattcaagaccacacatgcgccaccaggggacacgctggtgcacgctggggacctgcttactgccctctacttcatctccaggggctccatcgagatcctgcggggtgatgtcgtggtggccatcttggggaagaacgacatctttggagagcctctgaacctgtatgcacgtcctgggaagtccaatggggatgtgagggccctcacttactgtgacctgcacaagatccatcgagacgatctgctggaggtgttggacatgtaccccgagttctcagaccacttttggtctagcctggagatcaccttcaaccttcgagataccaacatgattcctggctcccccagcagtgcggaactagagagcggcttcaacaggcagcgaaagcgcaaactgtccttccgcaggcgtactgacaaggacacagagcagccaggggaggtgtcagccctggggcaaggccctgcccgagttgggccagggccgagttgccggggacagccgggagggccatggggggagagcccatccagtggcccttccagcccagagagcagtgaggatgagggcccaggtcgcagctccagccccctccgcctggtgcccttctccagccccaggcctcccggagactccccaggtggggagcctttgacagaggatggagagaaaagcagtgacacttgtaatcccctgtcaggtgccttctctggggtgtccaatattttcagcttctggggggacagtcgggggcgccagtaccaggagctgcctcgatgccctgccccggcccctagcctcctcaacatccccttgtctagccctggccggcgttcccggggtgacgtggagagcaggctggatgcactccagagacagctgaacaggctggaaacccggctaagtgcagacatggccactgtcctacagctgctacagaggcaaatgaccctggtccctcctgcctacagtgctgtgaccacccctgggcctggccccacttccacgtcccctttgttgcctgtcggccccgtccccactctcaccctggactcgctttctcaggtttcccagttcgtggcgtttgaggagcttcctgcaggagccccagagctcccccaagatggccccactcgacgcctctccctgccgggccagctgggggccctcacctcccagcccctgcacagacatggctcagatccaggcagttagtgacgctgcccggtgtggacacgtggctcaccctggggtcaggggattacctgaccgctctccttggagaccctggtttgaaggggagaacagtgcaggagcacctcctcccccgcccttgggaccagcatctcctcctgcaataccctgggccccactgggaggggcaggggcagagctgggcagtggacagggggtctgtggtccccccactgccctgggggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctgaggaaaaaaaaa

SEQ ID NO: 4087 - DNA, 1380 bp, Rattus norvegicus
  Genbank Accession No. NM_053953
catcatagaaggtgaaagtctgtcctgattgagccttcctcagcagccaagaaactgcaaggtacacgaatgcagagctccaggctccgagggtcctgtgcactctggaagttggtgtggacgatgttcatcttgcttgtgttagtaactggggtttcagctttcaccactccagcagtggtgcacacaggaagggtttctgagtctcccgttacatcagagaagcacccagttcttggagacgattgctggtttcgtggcagagatttcaaatcggaattgaggctggaaggtgagcccgtggtcctgaggtgccccctggtacctcattcagacacctccagcagttcccgcagccttctgacatggagtaaatcggactcttctcagctgatcccaggagatgagccaaggatgtgggtgaaggatgatacgctctgggttctgccagcagttcagcaggactctggtacctacatctgcacattcagaaacgcgtcccactgtgaacaaatgtctctggaactcaaggtctttaagaataccgaagcctctttccctctcgtctcctacttgcaaatctcagctctctcctccaccgggttacttgtgtgccctgacctgaaagagttcatctccagcagaactgatggaaagatacagtggtataagggctccatcctcttggataaaggcaataagaaatttctgagtgcgggagaccccacacgcctattgatatccaacacatccatgggagatgcaggctattacagatgtgttatgacatttacctacgagggcaaggaatacaacatcactaggaatattgaactccgggtcaaaggaataaccacagaacccatccctgtgatcatttctcccctggagacaataccagcatctttggggtcaagactgatagtcccgtgcaaggtgttcctgggaactggtacatcttccaacaccatcgtgtggtggatggctaacagcacgtttatctcagtggcctacccaagaggccgtgtgactgaggggctacaccaccagtactcagagaatgatgagaactacgtggaagtgtcgctgatttttgatccagtcacaaaggaggatctaaatacagattttaaatgtgttgccacgaatccacggagttttcagtcactccataccacagtcaaagaagtttcttccacgttctcctggggcatcgcgctggcacctctgtctctgatcatcttggttgtgggggcgatatggattcgcagaaggtgtaaacgccaggctggaaagacgtatgggctgaccaagctaccgactgacaaccaggacttcccttccagcccaaaccaaataaaggaaatgaaataataaaaa

SEQ ID NO: 4088 - DNA, 2024 bp, Rattus norvegicus
  Genbank Accession No. NM_053957
ggtcttccgccgtcggaggaactcttagttaccgaccggtgcggagttcatcgtgtcagtacgcttcgtaggacacacgcaccgaaacacgcgaggactcgggaaaccagacgcacaggcagctcaggcccgcctctgccctcccccaaggccgtccctatcccgcccagtgtttgtttgcgcggtgccagttggcccggcggtctccggcgcagagaggctgggcttgtgtgccctgcagctccggaggtcgccttgggctgagaacgcaggccagtcgagactatgctgggcaaggattatatgctggccatcattctggtcaactgcgatgatgacttgtggggggaccaaaatctggagggggaaacaggcctaccccctggctggagaaagatccgtgatgctgcaggaacttattattggcatgtacccagcggtagcactcagtggcagcgcccaacctgggaactagcagaggacccaggaacgggaaaagaggggatttgggaactacgacctcccaaggggagatctttctccagcctggacagctcattgaaccgaagtaactctctaacatggtataatgaagattcctatgtccggagcctggagccaggagctaagtgctttgcagtccgctctctgggctgggtagaggtccctgaggaggacctggcaccagggaagagcagtattgctgtcaataactgtatccagcagctagcccaggcccgaaaccggagccagcctcatgatggtgcctggggtgagggccagaacatgctgatggtcctgaaaaaagatgccatgagcttgctgaatcccctggaccacagtctgatccattgtcagcctctggttcacatccgtgtatggggtgtgggcagctccaagggccgtgacagggactttgcttttgttgcgggtgacaaagacagctgtatgcttaaatgtcatgtgtttcgctgtgatgtgcccgcaaaagccatagcaagtcgtctacaggggctctgtgcacagatcttgtcagagagggtaggactcagtggagaagctgcttgttgttccccagatcctatttcccctgaagacttcccaaggcaagtggaattgctggatgcagtgagccaggctgctcagaagtatgaggcactgtacatggggatcctaccagtcaccaaagccatgggtatggatgtgctgaatgaggccattggtaccctcactggccgtggggaccggaaaacctgggtccccgctatgctcagtgtgtctgactctctgatgactgcacatcctattcaggcagaggctggtgcagaggaagagccactgtggcagtgtcctgtccgccttgtaacctttattggtgttggccatgatccacatacctttggcctcatcgctgatcttggttgtcagagcttccagtgtgcagctttctggtgccaacctcatgctgggggactctctgaagctgtgcaagctgcctgcatggttcagtaccagaagtgtctagtggcctcagcagctcggggtaaggcctggggtgctcaggctcgcgctcgcctgcggctcaagcggaccagctccatggactccccaggcggcccccttcctccccctctactcaaaggaggggttgggggtgctggagcagctcctcgaaagcggggtgtcttctcatttcttgatgccttcaggctaaaacctctcttctccatatgtcctaaattgatcttagagggctggggaaagaggctctatactcttccagtccctagggttctgtagcctctcaccttcctgccatccctgatcccttgcctactctgtatttatgaccaagttcgttgtttatatggatgactgagaggccctgcactctaacttaggcctgtagcaccactttcctttggtccttttgttccttgcccctgtccagccctgacaattggctctacctcatcaactttatagcagaatcagtgaaaataaaaatccctcagtaaaaaaaa

SEQ ID NO: 4089 - DNA, 2399 bp, Rattus norvegicus
  Genbank Accession No. NM_053959
gcggcgtggagccaggcagggctcaggctggtggagcgaccggggctggaggctgggagtgaggcgctcacggcctccccgcgccattatccgcgctcgctacgggcgaggccggcgccaggatggcagagatggggagcaagggggtgacggcggggaagatcgcaagcaatgttcagaagaagctgactcgagctcaggagaaggtcctgcagaaactggggaaggcggatgaaacgaaggatgagcagttcgaacagtgcgtccagaatttcaataagcagctgacagagggcacccggctgcagaaggatcttcggacctacctggcttctgttaaagccatgcacgaagcctccaagaagctgagtgagtgtctccaggaggtgtatgagcctgagtggcctggcagggatgaagcgaacaagatagcagagaacaatgacctgctatggatggactatcaccagaagctggtggaccaggctctgctgaccatggatacctacctgggccagttccctgatatcaagtcacgcattgccaagcgggggcggaagctggtggactacgacagcgcccggcaccactatgagtctcttcaaaccgccaaaaagaaggatgaagccaaaattgccaagcctgtctcgctgcttgagaaagccgccccccagtggtgccaaggcaaactacaggctcatcttgtagctcaaactaacctgctccgaaatcaggcagaagaggagctcatcaaagcccagaaggtgttcgaggagatgaatgtggacctgcaggaggagctgccatccctgtggaacagccgtgtgggtttctatgtcaacacgttccagagcatcgcgggtctggaggaaaacttccataaagagatgagtaagctcaatcagaacctcaatgatgtcctggtcagcctagagaagcaacacgggagcaacaccttcacagtcaaggcccagcccagtgacagcgcccctgaaaaagggaacaagagcccttcacctcctccagatggttcccctgctgctacccctgagatcagagtgaaccatgagccagagccggccagtggggcatcgcctggggctaccatccccaagtccccatctcagctccggaaaggcccaccggtccctccgcctcccaaacacaccccatccaaggagatgaagcaggagcagattctcagcctttttgatgacgcatttgtccctgagatcagcgtgaccaccccctcccagtttgaggcccctgggcctttctcagagcaggccagtctactagacctggacttcgagccccttccaccagtggcaagccctgtgaaggcacccacaccctctggtcagtcaatcccatgggacctctgggagcccacagagagtcaagctggcgtcctgccttccggggagcccagttctgctgagggcagctttgctgtggcctggcccagccagacagccgagccagggcctgcccaaccagcagaggcctccgaggtggtgggtggaacccaggagccaggggagacagcagccagtgaagcgacctccagctctctcccggctgtggtggtggagaccttctcagcaactgtgaatggcgccgtggagggcagcactacgactggacgcttggatctgcccccgggattcatgttcaaggtgcaagcccagcatgattacacggccactgacactgacgagctgcaactcaaagctggcgatgtggtactggtgatccccttccagaacccagaggagcaggatgaaggctggctcatgggtgtgaaggagagcgactggaatcagcacaaggaactggagaaatgccgcggcgtcttcccggagaatttcacagagcgggtgcagtgacgggagagcctctgcagccttccggtgtgtgaagaaccttttcccaaaagatgtgtgcttttcttttctttgtttttcttcctcttcttttctgttttttgttttgttttgaaactcttgaaaagtgtcgggaaattggggagcggaaacctaagccaagaggtgtacccccaaagatgaggtggttttccaaaaagccgtccgacccagttcagtggacttctccagtattcccgaagctgctgtgtccccctcctagttgagttcccgatgcccgcatgttcagggcgggccgggggtgcagagccaccgccgcacttgcctgacgcttggccgcgccaccggacagggcttgggtcctcttctggcagctgccctgggcagggcctgcactgtggcccagcctggtccgctctgcagaccaaccgtgtgctgtttgaaaataagccctagtgttcaaaatgcagcgaaacaaacaaaaatgaaaaaccggacaaacccaccaaaaaa

SEQ ID NO: 4090 - DNA, 4529 bp, Rattus norvegicus
  Genbank Accession No. NM_053961
aagcttcttgatttcacttttcttcagtcacaaacttgaggatggagctttaagagtatacacatggcctactattcggctatcacccaggcccagcttaggctctttttaaaaaaaagtcatttttttttaagatttatttattttatgtctatgagtacactgtagctgtcttcagacacaccagaagagggcatcagatctcattacagatggttgtgagccaccatgtggttgctgggaattgaactcaggacctctggaagagtagttgggtgctcttaaccgctgagccatctctccagccccccctttttttaaaaatatatttattgtatatatgtgagcacactgttaccatattcagacacaccagaagagggcatctgatcccttacagatggtcgtgagccaccatgtggatgctggggattgaactcaggacctctggaagagcaaccagtgttcttaaccactgaaccatctctccagtccatctgtatggctttcttttttttggttctttttttttttttcggagctggggaccaaacccagggccttgcgcttcctaggcaagcgctctaccactgagctaaatccccaaccccctgtatggctttcttaattgccagattttaacttcttctctcacctcctctaactactgcaatagatactcaactgcgctcagcctcagtcttctcccttctgatgcattctcttcattcattatccttttttatagtgagaaaaggttgctctataaagtccaggctgacctgagactaaattggccgtgctggcttcccattcacagagacccaccggcctcagctgagtgctggggtcaaaggctctagccatcatgcccagctgcaatgtcttttcttaaagggacatcaggcccgctggattggggcctgcctgtaggaggtcacttagctttaattatttctctaattactacaattatctctctaaatgcaattgtagtgcatctgaggcacgtgatttaatctgtgttatcccaaagtcctcttcaggtttcctcaggtctccagtgctctccttcccaggaaggcttggaactaaagccacatcatggtttttttgttttttttttctttttttcggagctgagctggggaccgaacccagggccttgcacttcctaggcaagcgctctaccactgagctaaatccccaaccccccacatcatgtttacgtgatgttttcatccacgaatctgagaaaacgctccacttaaagcctctggtggctgtaaaccccttgagactagtgagtctttatcttaccctcctgagtttgcctttacatagcttcatagagctcagcatgcttaaccatatcctgtttcccgttgcttcacaaatgttccctacctttcaaagtcatggctccccaactacctgggtacctcgatgacacgagtaagcaggactgactcgtaatacaggatcttcaaaggtggaaagccatgagatgggagtgaagattttaacacttaactgggtagatgggagccctggagaccacactcacaactcaaaaaggtaaggaggacatacaggtcttttttgggacatagccatgtgacactgtgacagaatgaccagtgtgtcatacttgcacagcctgtgtagaggtcaaggtcagtatggctggtcaaatggagggcagctagctgcctattagaggggcggtcattaggcgacaactgtaaaaagcacagctgaaggactgatcgctcctagggatggtggaggaggaattttattgtagataaaagggagagagcatagtcagagcaaagacggctgggagagtcagaggggcagcctgggttaagacactgacgaagagagtgccatagctaaaatggctggattatataaggaaaggcagctggacgaagggcagtccagaccttgggttggggaagtttagggtggggagcagggcatgcctgccataccctgaaggattctgggaaaacctcatggccaggtccactttgatgttagtcacctcagtttgtcccagggtttcagacttaacagtaataagaaagatagaaagtgcccgacataatccagctttggtttcatgattctacaggtgtgtgtgtgtgtgtgtgtgtgtgtgtgtgtgtgtgtgtgtgtgtgggtgtgtgtgtgcgtgcatatagaggtcactgattaagctcaatttggtgatcttcctcgcttccccagtactggcaagaattccacacccagctttttatgttttgtttttgtcattttgagacccaggttgactctgaagggcctagacctcactctgtagaccaggttggccttgaactcaggttcaccagccttggacttaggagtggtaagatgtgcttttcccttgggtgctgaggatgggacttatatgtgatgtgtacgagtcctggaacagggtatgtggatcagattttgatcagcctgccagttttccagtgagcactgggattgaaggcctgtgctgcctcacacagcctgctagctatgatccctgtgtcttctccagtgaggaattcattccttcgagcctttatcactgtgctgacttcccacgggaacaatcatcacgtggcatgagctactccctgaaaacggaacagcccagcctggtcttgtcaccctcctgccttgtgctgaaattaggcctgtaggcctgtgccacctactatacctgaccaaaagtagaatggcgaataggccttttcccaaccttctggggcaggggtggccccattgcctaagtgccccgcgggcctgtccagcgctgcaccctgtgacctacaagggcttggcagcgactaccagtgacaaacagctgactaaccgggggaagcgacgggtctcaacggacctcatgacagcccagcgcagagaaggcagggacgccgccacgtcttgttccaaggcgagagagggcaacgagggaattgttgaggctgcgcctcgcgcctctcctcacgcgagaacgccgcgaaacccagcctagacgagtggcacggagtgcgcgtgcgcgacagtcccacttcgcaggcccttccgtcacgtggccccagcccacctccccccacctcccccccaccgtgcccccgcttctctcactacacatgcgcagccgcccctctctgccccgcccctctgcggccggtctcttccaccctagaggccgcctgagcctctccgagtggccacgtgcgctcatgcgcgccggcgggacggccctcccagtgacgtgaccgcccactcggagcgctcctgctgtagcttgcccatctcccgctcccacaatccggcgtgatggctgccgccgttcctggcgccgtttcgctctccccactgctgtccgttctccttggcctgctgctcctctctgctcctcatggcgccagcggcctgcacacgaagggcgcccttcccttggacacagtcactttctacaaggtcattcccaaaagcaagttcgtcttggtgaagttcgacacccagtacccctatggagagaagcaagatgagtttaagcgtctggctgagaactcagcctccagcgatgatctcttggtggcagaggtggggatctcagactatggtgacaagctgaacatggagctgagtgagaagtacaagctggacaaagagagctacccagtcttctacctcttccgggatggggactttgagaatcctgtcccatacagcggggcagttaaagttggagccatccagcgctggctcaaggggcagggagtctatctgggcatgcctggatgtctgcctgcgtacgatgccctggcgggccagttcatcgaggcctccagcagagaggcccgccaggccatcctgaaacaggggcaggatggcctctcaggtgtgaaggagacagacaagaagtgggccagtcagtacctgaagatcatggggaagatcttggaccaaggtgaagacttcccggcctccgagctggcccggatcagtaagctcattgagaacaagatgagtgagggtaagaaggaagagctgcagaggagcctcaacatcctcaccgccttccgcaagaaaggcgccgagaaggaggagctgtgagggcaccaggctgctagggtttgctgagggcggggagggagagccgcctgctgactgtggggccctgtgggtggagggggcagtggagcaaagcagtcctgagccagagacctgtgccccgagtgcctggacactgaggctgctgagaccataccctggacatccttggagcagtttgtggggagcctgtgtgccaagacaagatggctgtgtcccacaggagctggtactatagaggaaggtccttgacaggtatagttctgatcaaataaaagtctgttttggttagatgattttcttctcagatagtactttttggcccctgtcaagagtctgagctgttgtgcattctattctgccaagacttgcctgcgtaa

SEQ ID NO: 4091 - DNA, 1231 bp, Rattus norvegicus
  Genbank Accession No. NM_053965
acagcgacgaagatcaagactgccaggagctgcaagtagactgacagaagactgaccatggcagaggagccgaaacccatcagtccgcttaagaacctccttgccggcggctttggcggcgtgtgcctggtgtttgtggggcaccccttggacacggtcaaggtccgactgcagacacaaccaccaagtttgcctgggcagccacctatgtactctgggaccatcgactgtttccggaagactctttttagagagggcatcacagggctgtatcggggcatggctgcacccatcattggagtcacccctatgtttgcggtgtgcttctttgggtttggtttgggaaagagactacagcagaaatctccagaggatgaacttacctacccgcagctgtttacagctgggatgttatctggtgtgttcaccacaggaatcatgacccctggagaacggatcaaatgcttactgcagattcaggcttcttcagggaaaaacaaatacagtggtaccttggactgtgcaaagaagctgtatcaggagtttgggatccgtggcttctacaaagggactgcgctcactctcatgcgagatgttcctgccagtgggatgtatttcatgacatacgaatggcttaaaaatctcttcactccacagggaaagagtgtccatgacctcagtgtgcctcgggtcctggtggctggcggctttcgagggatcttcaattgggttgtggcaatccccccagacgtgctcaagtctcgattccagaccgcacctcctggaaaatatcctaatggtttcagagatgtgttgagagagctgatccgagaagaaggagtcacctccttgtacaaagggttcaatgcagtcatgatccgagccttcccagccaatgctgcctgtttccttggctttgaaattccgatgaagatcctcaattggattgcccccaacttgtgaggctgaagacatgttgaagacctttggatgctggaagactgttgccgagaagcaggggcaggactgggaagaccctgagggtgaggggagggaagtggtgtgatcagagccccaggcatgactgtgatggtgaaactgttgccttaatgacatcctctaccttatgtaacttggtgccattttgaaacttgaatatagaaggtttccagagaattggagatggaataaatagtttatagactcgtcaaaaaaaaaaaaaaaaaaaaaa

SEQ ID NO: 4092 - DNA, 963 bp, Rattus norvegicus
  Genbank Accession No. NM_053971
ctctttcccgtcttgcaagatggcgggtgaaaaggcggagaagcctgataaaaaggagcagaaacctgcagccaagaaggctggcggtgatgctactgcgccccgcgccggggcctggtgcgtcaaaaagagtagttctaaggctaaaaagctgaggaagagtaagccccattgcagccggaaccctgtcctggtgagaggaatcggcaggtattcccgatctgctatgtattccagaaaggccttgtacaaaaggaaatactctgctgccaagacaaaggttgagaagaagaagaagaaagaaaaggtccttgctaccgtcacaaaaacagttggtggggacaagaacggtggcacccgggtggtgaagcttcgaaaaatgcctaggtattaccctactgaagacgtgcctcggaagctgctgagccacggcaagaagcccttcagccagcacgtgaggcggctgcgctccagcatcactcccgggactgtcctgatcatcctcactgggcgccacaggggcaagagagtggttttcctcaagcagctgggcagtggcttgctacttgtgactggacctcttgccctcaacagagttcctctgcgtaggacacaccagaagtttgtcatcgccacctctacgaaagttgatatcagcaaggttaaaattcccaaacacctgactgatgcttacttcaagaagaagccacttcgcaagcccaggcatcaggagggtgagatcttcgacacagagaaggagaaatacgaaattacagagcagcgaaaggctgatcagaaagctgtggactcgcagattttgccaaagatcaaagctgtcccccagctccagggctacctgcggtctcagttctccctgacgaacggcatgtaccctcacaaactggtgttctaattgttaacaacctaattaaactgcttcataaggaaaaaaaaaaaaaaaaa

SEQ ID NO: 4093 - DNA, 1647 bp, Rattus norvegicus
  Genbank Accession No. NM_053974
cctctcgcccccccttcaggagcggttgtgcgatcagatcgatctaagatggcgactgtggaaccggaaaccacccctaccactaatcccccacctgcggaagaggaaaaaacagagtctaatcaggaggttgctaatccagagcactatattaaacaccctctacagaacaggtgggcactctggttttttaaaaatgataaaagcaaaacttggcaagcaaaccttcggttgatctctaagtttgatactgttgaagacttttgggctctatacaaccatatccagttgtctagtaatttaatgcctggctgtgactactcactttttaaggatggtattgagcctatgtgggaagatgagaaaaacaaacggggaggacgatggctaattacattgaacaagcagcagagacgaagtgacctcgatcgcttttggctagagacactgctgtgccttattggagaatcttttgatgactacagtgatgacgtgtgtggagctgttgtcaatgttagagctaaaggtgataagatagcaatatggacgactgaatgtgaaaacagagatgcagtcacacacatagggagggtatacaaggaaaggttaggacttcctccgaagatagtgattggttatcagtcccacgcagacacagctacaaagagcggctccaccactaaaaataggtttgttgtttaagaagacaccttctgagtatcctcacaggagactgcgtcacgcaatcgagattgggagctgaaccaaagcctcatcaaagcagagtggactgcactgaagctgactccatccaagtgttgctaagatataagagaagtctcattcgcctttgtcttgtacttctgtgttcattctcctccccaccccaatttttgctagtgtgtccacatcccaatcaaagaattacagtatacgtcaccccagaacccacagatgtgttcctggcccgctctgtaacagccgggtagagttaccacgacacacacttgcctttccacagtattcgaaaaagaacgtgcatttctgtcaccttagcaggaaaagatctggttttgttccactccatgcaggagcggatttgctggtgtgagagtctaagtacagctttctagcaaccttctgttttctgtcacagcattgtccttgctgtcctcttgctgatggctgctagatgttaatttatttgcttccctccttgataacattagtgattctgatttcaggtttttcatttgtttggcttttgtttttttcctcatgtaacattggtgaaggatccaggactatgacagaaaggtggaataaacattacatttgtgcattctttggtaagtttttttgttttttgtaactacaaagctttgctacaaatttatgcatttcattcaaatcagtgatctatgctgtgtgatccctaaacataattgtggactataaaaatgtaacaccataattacattcctaactagaattagttgtctgcttttgtatctttatgctgtactttaacactttgtattacttaggttattttgctttggttacaatggctcaagtagaaaagcggtcccatccatattaagacagtgtacaaaactgtaaataaaatgtgtacagtgaattgtc

SEQ ID NO: 4094 - DNA, 3628 bp, Rattus norvegicus
  Genbank Accession No. NM_053977
gaattccattgggcatcgtgggcaaaacttccgaacgtcctctgcagagtctggtgtggaatgacactgggcgtgtagcaccctgaactggccatcttgtttcaggaagtggaagtcacagtctccctccaccgcatgctcgcctgttgcctcacagaacaatttgctaagggggttgaagggagaggttagaggagagagcaggttgaggaagtgtctcttggggttcttcagccacagcaagtatctccacggctgaatggacgacaacgacttttaagcagtattttcttacttacagaaaggagtccaagtgaagagagcaacatggtctctgcccagcttcacttcctgtgtcttctcacgctttatttgactggcgcatatggccaagaagggaagttcagcggccccctgaaacccatgacattctctatttttgaaggccaagaaccgagtcaaatcatattccagtttaaggccaaccctccagctgtgacttttgagctaacaggagagacggatggtatatttaagatagaaaaggatggacttctttatcacacaagagtcctggacagagaaacaagggcggttcatcatctgcagcttgcagccttggattctcagggagctatagtggatggcccagtccccatcatcatagaagtcaaggacatcaatgacaaccgacctacatttctccagacaaaatatgaaggctcagtgaggcagaactctcgcccaggaaagcctttcatgtatgtcaatgctacagacctggatgacccggctactcccaatggccagcttttttatcaaattgtcatccagcttcccaaaatcaacaatgttatgtacttccagatcgacaacaaaacaggggcaatctcgcttaccccagaaggttctcaggtattggatccaataaagaatccgtactacaacctggtggtctctgtgaaggacatggggggccagaatgagaattccttcagcgataccacatctgtggatattactgtcagagagaacatctggaaagcaccagagcctgtggagattcgagaaaacttaactgatcctcaccccatcaaaatcactcaggtgcagtggaatgacccaggggcccactattccttaatcaacaaggagaagctgccacagtttccattctcgatcgaccaagaaggaaatatttacgtgactcagcctttggaccgtgaggaaaaggactctcatgttttctttgccactgccaaggatgagaatggaaaaccccttgcatatccactggaaattcgtgtgaaagttattgacattaacgacaacccaccgacatgtctctctcaagtgactgtatttgaagtccaggagaatgaagtcttgggtagtagcattgggatctttgctgcccacgatatggatgaagctaacaatatcaacagtattttgaagtacagacttgtagaccaaacacccaaagttccctcagatgaactctttctcattgacgaatatggaggaaaggtccagttgggtaaacggtccttgaagaagcaagacagtcctcagtacaacttaacagtagaggtgtctgacatagatttcaagactctctgttctcttcaagtcaacgttattgatatcaacgatcagattcccatctttgaaagatcagactatggaagcaagactctttctgaagacacagccatcggatccaccatcttaatcatccaagctactgatgatgatgagccctttaccgggagctctaaaattctgtacaagattgtacagggagacactgagggaagactggaagttgtcacagatcccatgaccaatacaggatacgtcaagatcagaaagcctcttgattttgaaaccgaaccagttactagcattgtgttcaaagcagaaaaccctgagccgctggtgaatggcatagagtacaatgctagttcttttgcctccttcgagctgaccgtgacggatgtgaatgaagtgcctgtatttccccagcaaatattccaagccaacgttagcgaggatactgctataggcactaaagtgggcactgtgactgccagggatccggaaggcctgactgtgagttattcactgaaagacaataagagaggttggcttaaaatcgactccgtcaccggcgacatatttagcactgctccgctggacagggaaacagaaagtgtgtatcgagtacaagtggtggccactgaagtaggtgggtcctctctgagttctacagcatatttccacctggtcctcatggatgtgaatgacaacccccctcgcctagctaaggactacacaggcttgttcttctgccatcccctaagtgcccctgggagcctcatctttgaagccactgatgatgaccagcagtcagttcggaggcccaagtttacgtttgcccttggcagagaaagcttacaaagtgactgggaagtgtccaaaatcaatggcacacatgctagactctccaccaagcacacacgctttgaggaacaagtttatgacatcccaatcctcatcaatgatggggggcagccacccatggaaggcattgtctccttatcagttactttctgccagtgtgtggacggaagttgtttccggccagcaggcaaccaggttgggatacccaccgtgggcatggcagttggtatacttctgaccacatttctggtcattggtataattttagcggttgtattcatccgtatgaggaaagataaagttgaagatccacagtcccctgagaataagcctctgaggagctgaatttgaacagaaatgttcaaggttgtacaccaagcactgtatcaatgcctcagctgtttaatttcatccaaaatgtgaactataattggtagagtttatgcatcatgtgctatatctggtccccagctgtttaatctcataatttcatccaaaatgtgaactataatttctttgatggcatgccttcttgtcctgcaacacttaacgctacttagatattttatctctgtagacattagagttactctccattcccccataacattttgctcctttacaaaagcctacataacatgaactttcccttctggaaagaagatgaactaggtataaaccctgtgtgctgttgtttcagagacaagtctgttttctcccaactgacttttctaggctccacttatccctttctgtttccacctgcgccccctgatctcagcattacattaaatttaaaatgtgtcacacaaaagaacaaagtgaagtccttggggggggtgttgctaagtggacagccttattctttagcacaaacaacagcttctctgtgttgtcatctttaatagaggtcctccagcttggctatggtgtagaccctggggaggtatcaaatacaactgccgtgtttcaagaaagacctacttcatgaggcacaggaactgacgagctgtctgggtttactcactactccgtgcttacatacatgctgtacatgttttatttgtatattgaagttttgttatatatttatcatgtggaggaaagacgaaagcatgtacgtggtgaagaaatccaaaataaatgttggtttcaggaattc

SEQ ID NO: 4095 - DNA, 2717 bp, Rattus norvegicus
  Genbank Accession No. NM_053979
agcctgagcccgggcggctggagggctccgctgcccgaggatgggaattctcttcacccggatctggagactgttcaatcaccaggagcacaaagttattattgttgggctggacaatgccgggaagactaccatcctttaccagttttccatgaatgaagttgtacatacatctcctacaataggaagcaatgtggaagagattgtggttaataatacacgtttcctgatgtgggatattggtggccaagaatcccttcgttcttcctggaacacttattatactaacacagagtttgtaatagttgtggtggacagcacagacagagaaagaatttctgtaactagagaagagctctacaaaatgctagcccacgaggacctaaggaaagctgggttgctgatttttgctaataaacaagatgttaaagaatgcatgacagtagcagaaatctcccagtttttgaagctcacttctataaaagaccaccaatggcatatccaagcatgctgtgctctcactggcgaggggttatgccaaggacttgaatggatgatgtcacggctgaagatcagatgatctcttctgaccccttctcatggactctgtataaacaaagtgctggactttatctgaaagctgcaaaaaatggtttagatatatttataataaactgacttaagagttttctacaagaagaaaattaagaccatttatttgaaaacagatgaaatgtcaccacctcgtttgctctctcattccttccaaacctgtgactggtattttctcatgatgaatcctctccggacatgggagagttctaatgaatacaagggagaggaagacatttgaacttggagctttatttcctcgacgagcccaccctgccccaagtgaatgttcccttttcattacattgaatcaaatacggatcagcacggatactgtttccagtttttaaaaatgtaataatattatggaaagtattttacttaaagttgaatatgtattgtgtatatacctcaagttcaggttaatggctttgatttatttgtgttctaaaggaaagcaaataacacaagttaatgacgttattttcctgatgtcactgagtaccatcttggtgttaattgtcactgtttagtttaccctctgttctctgtattgttctaacaagccaaccccagcccagaatcggtaagctgctccttaaaaatgaaacgggagaaagcttgacattgtgtacctatttttgttgctcagtcatacagatggaaatccataacgcaagtgggtagagtctgctggactcctggcctggtgtggccgggcagaattactcgagaagcagttgtcagactttcccttctgctggtcctaattcagccaattcagctactaatcggtcattcataaattgtgattaaaatgatcaggtaatttttaattgaaaatcatgttgtgaaatatatctacccaaagaggtaacatcctataaatagtaataattaatttagctgcagccttttcaggtattaaattatatgacaaacagttaaaatgaatttaagagtaaacataaggcatagttttcagtgaacattaataatttctcaatttgcagattagcatctgcaaaggtatcttcttccattgcataaaatgccttgtttaatagttaactaatcaaatattctgaatgacttcaaaaatttgattgaaaatttgagatatcacattatttgtactaggatttgacctaaaacaccttttatatttgttaacctttcttaaatttagttaaaatttgaagtatttctgtcgtaattataaacaaaattattttgtgttttaacatattcttggtgactctttatactttttgtgccctgaaaatttgaaggttactccaaactgtcaagatttaggatattcaagaaaagatttaactagttttagtgtcagactttaaaatttcctaaggaatttggtaagaaatagaagtccactctataagcattgaggaaactttgaaaaacctttaagtaaatgtaagactcttaatgactaaacccatcggagtggatgagtgttcccctggaggcttgtgtttgagacctgtgctgtaagcctcccacttgaccttcagcgtaatgtttcccacctgctcagagtgtcagcactcgtcactaggctttccagggctaagtccttcctgttcacatgttctcacactttttcaaatcatgaggctttctcctgtatagtaaaaatccccttaaagactcaaatctacgtcgtagttttgtcagagaccaatagtccatcgagcccccacctaccccagatctgcagcttcttagcttttatctgaatagtccttgcacagttgcttgcctctctgtcacatcagttcagcacatagcagcacatcctggtgttgccgaggtattggctagaatttattcttaattagatgtttaaagcatttactccactgttaaagttgtcttagtgtagtcaggtattgacatgacataagaaagcatgaaactaccacatttacaaaatatgagggatttggggtttggttttttttgtttgtttggttggtttttttttttttttggtttttaactattttagactcaaataatatcatacctgtgtacttgtacataaaaacaaaattattactgagtaaaaagattaatcg

SEQ ID NO: 4096 - DNA, 943 bp, Rattus norvegicus
  Genbank Accession No. NM_053980
actccgcccgtgctgggtctgtcgatcctcgttccgtcaaggaccgtgaaggggtcaacgtgaggtcggtggggttagtaacgcggtggcggcggctcctcctccaaaatttgagcaggtacagggtgccaaacaggatgtacacgctgctttccgggctgtacaagtacatgttccagaaggatgaatactgcatcctgatcctgggcctggacaatgctgggaagacgaccttcctggaacagtcaaaaacacgatttaacaagaactacaagggaatgagtctatccaaaatcaccactaccgtgggtctaaacattggcactgtggacgtaggaaaggctcgtctcatgttttgggacttaggtgggcaggaagagctgcagtcgttgtgggacaagtactatgcagagtgccatggtgtcatctatgtcattgattccactgatgaggagaggctgtcagaatcaaaagaggcatttgagaaggtggtttcgagtgaagcactggacggtgttcccatcctggtgttggccaacaagcaggatgtggagacttgcctctccattcctgacatcaagactgcattcagtgactgtacctgcaagattggcaggcgagattgtttgacccaggcctgctctgccctcacaggcaagggagttcgagagggcatcgaatggatggtgaagtgtgtcgtacggaatgttcaccggccaccacggcagagggacatcacataagcaccttcatcctcacagtcttggactgttcatcccctagtgttggaagagtattctctgctggcttctgtcctcctgatgctgggggttgagctgggtttgtctgttcatttttatttgctttatgttttctctaagacaaacttttctctgtgtctggaaaagtgtaggtattcagagacaaaaaaaaaaaaaaaaaa

SEQ ID NO: 4097 - DNA, 449 bp, Rattus norvegicus
  Genbank Accession No. NM_053982
accgtcaccatggtgcgaatgaatgttctggcagatgctctcaagagcatcaacaacgcggagaagaggggcaaacgccaggtcctcatcaggccgtgttccaaagtcatcgttcggttcctaactgtgatgatgaagcatggctacattggtgaattcgagatcattgatgatcacagagctgggaagattgttgtgaacctcacaggaaggttgaacaagtgtggagttataagccctagatttgatgttcaactcaaagacctagagaagtggcagaacaatctgctcccatcacggcagtttggtttcattgtgctgacgacctcggctggcatcatggaccatgaagaggcaagacgaaaacatacaggagggaaaatcctgggattctttttttaaatgtaaagcataaataaaaagcctctgtggactgtgaaaaaaaaaaa

SEQ ID NO: 4098 - DNA, 1107 bp, Rattus norvegicus
  Genbank Accession No. NM_053985
agcggtttggtcgttcgttggaggagcttcgtcttgttctgctctgcgattgcggcgcttgttcgagcgcttacagcggcgcgtcggtcccagcaagggcctcagacttcagctttgggtgagagaagatggcccgaaccaagcagaccgctaggaagtccaccggagggaaagccccccgcaaacagctggccaccaaggcggcccggaaaagcgcgccctctactggcggggtgaagaaacctcatcgctacaggcccgggaccgtggctctaagagagatccgtcgttaccagaaatcgactgagctgctcatccggaagctacccttccagaggttggtgagggagatcgcccaggatttcaaaaccgacttgaggtttcaaagtgcagccatcggtgcccttcaggaggctagcgaggcatacctggtggggttgtttgaagataccaatctgtgtgccatccacgccaagagagtcaccatcatgcccaaagacatccagttggctcgccggatacggggggagagagcttaagttgaagcgatttttatggcattttgtagtaaattctgtaaaatactttggtttaatttgtgactttttttgtaagaaattgtttataatatgttgcatttgtacttaagtcattccatctttcactcaggatgaatggaaagagtgactgttcacagacctcagtgatgtgagcactgtggctcaggagtgacaagttgctaatatgcagaagggatgggtgatacttcttgcttctcatgatgcatgtttctgtatgttaatgacttgttgggtagctattaaggtactagaattgataaatgtgtacagggtccttttgcaataaaactggttatgacttgatccaagtgtttaaccatacatcactgtgatagaatgtgggctttttcaaaggttgaagatacaagttttagccacagtgtaacagtttcctttaaaaaaaaaaaagtaaacctggcagctatagaatacactatgtgcatttataatagctattttatatattgtagtgttcaacatttttaaattaaatgttttacattcacaaaaaaaaaaaaaaaaaaaa

SEQ ID NO: 4099 - DNA, 3180 bp, Rattus norvegicus
  Genbank Accession No. NM_053989
agctagaagagagaggatgactgcacgagaagaggccagtttaagaacacttgaaggcagacgacgtgccacattgctgagtgcccggcaggaatgatgtctgctcgaggagattttctcaattatgccctgtctttaatgagatctcataatgatgagcattctgacgttcttccagtgttggatgtgtgctcattgaaacatgtggcatatgtttttcaagcccttatatattggattaaagcaatgaatcaacagacaactttagacacccctcaactggagcgcaaaaggacacgagaacttctggaactgggtattgataatgaagattcagaacacgagaatgatgatgacaccagtcaaagcgctactttgaatgataaggatgatgaatctcttcctgcagaaaccggccaaaaccatccatttttccgacgttcagattctatgacattccttggatgtatacctccaaatccatttgaagtgcctttggctgaagccatacccctggctgatcagcctcatctgttgcagccaaatgctagaaaggaagatctctttggtcgcccaagtcagggtctttattcgtcatctgccggtagcgggaaatgcttagtggaagttacaatggacagaaattgtctcgaggttcttccaactaaaatgtcttatgctgccaatctaaaaaatgtaatgaacatgcaaaaccggcagaagaaagcaggggaagaccagagcatgctggccgaagaggctgacagttcaaagccagggccatccgctcacgatgttgccgcccagttgaaaagcagtttactagcagagataggactcacagaaagcgaagggcctccccttacatctttcaggccccagtgcagtttcatggggatggtgatctctcatgacatgctgctggggcgctggcgcctctctttagaactgtttggcagagtattcatggaagatgttggagcggagcctggatcgatcttaactgaattgggtggttttgaggtaaaagaatcaaagttccgtagagagatggaaaaactgagaaaccagcaatcaagagatttatcactagaggttgatcgagatcgagatcttctcattcagcagactatgagacaactcaacaatcattttggtcgaagatgtgctaccacaccaatggctgtccacagagttaaagtcacatttaaggatgaaccaggagagggcagtggtgtagcacggagtttctatacagccattgcacaagcctttttatcaaatgaaaaattgccaaatctagattgtatccaaaatgccaacaaaggtactcatacaagtttaatgcaaagattgaggaacagaggcgagagagatcgggaaagagaaagagaacgggaaatgaggaggagcagtggcttgcgagcaggatctcggagagaccgcgatcgagacttcaggagacagctgtccatcgacaccaggccttttagacctgcttctgaggggaaccctagtgatgaccctgaccctcttccagctcatcggcaggcactcggagagaggctgtacccccgagtgcaagcgatgcagcctgcctttgccagtaaaatcaccggcatgctgctggagctgtccccagctcagctgcttctccttctggcgagtgaggactctctgagggcgagagttgaggaggccatggagctcatcgtcgcccacggacgggaaaatggagctgacagtatcttggacctcggattattagactcctcagaaaaggtacaggaaaaccgaaagcgtcatggctctagcagaagtgtggtagatatggatttagatgacaccgatgatggtgacgacaatgctcctttgttttaccaacctggaaagcgagggttttatactccgagacctggcaaaaacacagaagcaaggctgaattgtttcagaaacatcggcaggattcttggactatgtctgttgcaaaatgaactatgtcctatcacattgaataggcatgtaattaaagtgttgcttggtagaaaagtcaactggcatgactttgcttttttcgaccctgtgatgtatgagagtttacgacaactgatccttgcatctcagagttcagatgccgatgctgttttctcagcaatggacttggcgtttgcagttgacctgtgtaaagaagagggtggaggccaggttgaacttattccaaatggtgtaaatataccagtcactccgcagaatgtatatgagtatgtaaggaaatatgcggagcacagaatgctggtggttgcagaacagccattgcacgcaatgagaaagggtctactagatgtgcttccaaaaaattctttagaagacttaacagcagaggatttccgacttttggtgaacggctgtggtgaagtcaatgtgcagatgctcatcagtttcacgtctttcaatgatgagtcaggagagaatgctgagaagctcctgcagttcaaacgttggttctggtcaatagtagagagaatgagcatgactgagcggcaggacctggtttacttctggacatcaagcccatcattgccagccagtgaagaaggttttcagcctatgccctcaatcacaataagaccaccagatgaccaacatcttcctactgcaaatacttgtatttctcgactttatgtcccactctattcctctaaacagattctcaaacaaaaattactactcgccattaagaccaagaattttggttttgtgtagagtataaaaagtgtgtattgctgtgtaatattactagctaattttgtagattttttttcccatttgtctataaaagtttatggaagttaatgctgtcatacccccctggtggtaccttacagagattaaatgcaaacattccttgctgagtttgtagcttaaaggcctaagaagcactggcaccttttctctatgatggtttgctagtcgccaacttctaggtctaaccccagccaaagatgacagcagaacaacataatttacactgtgatttatcttttttgctgagggggaaaaaatgtaaaatgttctgaaaattcactgctgcctttgtggaaagtgtttcagcaaaggttcttgtatagagggaatagggaatttcaaaataaaaaattaagtatgaaaaaaaaaaaaaaa

SEQ ID NO: 4100 - DNA, 1494 bp, Rattus norvegicus
  Genbank Accession No. NM_053990
ttccgctcgcgctcccccgccgccatgtcggctaccatcgagcgggagttcgaggaactggatgctcagtgtcgctggcagccgttatacttggaaattcgaaatgaatcccatgactatcctcatagagtggccaagtttccagaaaacagaaatcgaaacagatacagagatgtaagcccatatgatcacagtcgtgttaaactgcagagtgctgaaaatgattatattaatgccagcttagttgacatagaagaggcacaaagaagttacatcttaacacagggcccacttcctaacacgtgctgccatttctggctcatggtgtggcagcaaaagaccagagcagttgtcatgctaaaccgaactgtagagaaagaatcggttaaatgtgcacagtactggccaacggatgaccgagagatggtgtttaaggaaacaggattcagcgtgaagctcttatctgaagatgtgaaatcatattatacagtacatctactacagttagaaaatatcaatagtggtgaaaccagaaccatatctcactttcattataccacctggccagattttggcgttccggagtcaccagcttcattcctaaatttcttgtttaaagttagagaatctggttctttgaaccctgaccatgggcctgcagtgatccattgcagtgcaggcatcgggcgttctggcaccttctctcttgtagatacctgtctcgttctgatggagaaaggagaggatgttaatgtgaaacaaatattactgagtatgagaaagtatcgaatgggactcattcagactccggaccagctcagattctcctacatggccataatagaaggagcaaagtatacaaaaggagattcaaatatacagaacagaacaatgactgagaagtacaacgggaagagaatagggtcagaagatgaaaagttaacaggactttcttctaaggttccagatactgtggaagagagcagtgagagtattctccggaaacgcattcgagaggatagaaaggctacaaccgctcagaaggtgcagcagatgagacagaggctaaatgaaactgaacggaaaaggaaaaggccaagattgacagacacctaaatgttcatgacttgagactattctgcagctataaattttgaacctttgatgtgcaaagcaagacctgaagcccactccggaaactaaagtgaggcttgctaaccctgtagattgcctcacaagttgtctgtttacaaagtaagctttacatccaggggatgaagaacgccaccagcagaagacttgcaaaccctttaatttgacgtattgttttttaacatgtgtatgaattgtagaaagatgtaaagaaaataaaattaggagagactactttgtattgtactgccattcctaatgtatttttatactttttggcagcattaaatatttttattaaatagacaaaaaaaaaaaaaaaaaaaaaaaaaaaaaaaaaaa

SEQ ID NO: 4101 - DNA, 1420 bp, Rattus norvegicus
  Genbank Accession No. NM_053995
ccctcaatagccacactatttattttatttcaattaaaaatttcttcccaaacctttcctgcacctccctcacccaaaactataaactcggtgccatgatgctggccgcccgtctttccagacccctgtcacagctcccaggaaaagctctaagtgtctgtgatagagaaaatgggacaagacacacactgttgttttacccagcttctttcagccctgacacccgtcggacctacaccagccaggcagatgcggctagtggcaaagctgtcctggttacaggctgtgactctggatttgggttctctttggccaagcatctacactcaaaaggtttccttgtatttgccggatgtttgttgaaggaacaaggcgatgctggggtcagggagctggacagcctgaagagtgaccggctgagaaccatccagctcaatgtctgcaacagtgaggaggtggagaaagcggtggagaccgtccgctccggcctgaaggatcctgagaagggaatgtggggcctggttaacaacgcaggcatctcaacgtttggggaggtggagttcactagcatggagacgtataaggaggtggccgaagtgaacctctggggaactgtgcgcacaacaaaatccttccttccccttctccgaagagccaaaggccgtgttgttaacatcagcagcatgctgggtcgcatggccaacccagcccgctcaccatactgcatcaccaagtttggggtagaggctttctcggactgcctacgctatgagatgcaccctctgggtgtgaaggtcagtgtggtggagcctggcaacttcatagctgccaccagcctctatagccctgagcgtatccaggccattgccaagaagatgtgggatgagctgccagaggtcgtccgcaaagactatggcaagaagtacttcgatgaaaagattgccaagatggagacctactgcaacagcggttccaccgatacgtcctccgtcatcaacgctgtcacccatgccctgactgctgccaccccttatacccgctaccatcccatggactactactggtggctgcggatgcaggtcatgacccattttcctggagccatctctgacaagatctacatacactgaagagctgaagaggtccctgcagcctctgccagggagcctgatgggagggagttcatacagttatcttttgattaaccattgtgggttgtccactgtcttaggaagacctattttaaccttacgtgttcaatgtggtgaatggtttgggccttcacaaatacagggcactggtgggtggccctaaccctcaaggccaatatggtgcttctatctgtctatctagagttgattttatataaagatttgtgggaaatacctttatattaaagacgttattagaatagaaaaaa

SEQ ID NO: 4102 - DNA, 2722 bp, Rattus norvegicus
  Genbank Accession No. NM_053996
aaaggcgcagagataggaccagtgctcggcgcccgcttggctggctgactgcgctcttgcaagcaccggtgccagctctccaagatgaagaagctccaggaagctcacctccgcaagcctgtcaccccagacctgctgatgactcccagtgaccagggtgatgtggacctggatgtagactttgcagcagacagaggcaactggacgggcaagctggacttcttgctgtcctgcatcggctactgtgtgggcttgggaaatgtctggcggtttccctatcgagcctacaccaatggaggcggagccttcctcgtgccctacttcctcatgctggccatctgtggcatccccctcttctttcttgagctctccctgggccagttctccagcctgggacccctggctgtctggaaaatcagccccctcttcaaaggtgcgggtgcagccatgctgctcatcgtgggcctggtggccatctactacaacatgatcatcgcctacgtcctcttctacctcttcgcctccctcaccagcaacctgccctgggagcattgcggcaactggtggaacacagaacgctgcctggagcacagaggccccaaggatggcaacggggcactgcctcttaacctcagcagcactgtcagccccagtgaggagtactggagccgatatgtcctgcacattcagggcagccagggcatcggccgacccggggagattcgctggaacctctgcctctgcctgctgctggcctgggtcatcgtgtttctctgtatcctgaagggggtgaagtcctcgggcaaggtggtgtatttcacagccacctttccctacctcatcctgctcatgctcctggttcgaggagtgacccttcccggggcctggaagggcatccagttctatctcaccccccaattccaccacctgctgtcttccaaggtgtggattgaagctgctcttcagatcttctactctctaggagtgggttttgggggtcttctcacctttgcctcctacaacacattccaccagaacatctacagagacaccttcattgtcactctgggcaatgccatcaccagcatcctggctggttttgctatcttctcggtgctgggctacatgtcgcaggagctgggtgtgcctgtggaccaagtggccaaagcaggccctggcctggcctttgttatctacccacaggccatgactatgttgcctctgtcacccttctggtccttcctcttcttcttcatgcttctgactcttggcctcgatagccagtttgcctttctggaaaccatagtgactgcagtgaccgatgagttcccatactacctacggcccaagaaggcagtgttctcaggcctcatctgtgtagccatgtacctgatgggactgatcctcaccaccgatggggggatgtactggctggtccttctggatgactacagcgccagcttcggactcatggtggtggtgattaccacatgcctcgctgtcacccgggtatacggcatccagcggttttgtcgtgacatccacatgatgctgggcttcaagccaggactctacttcagggcctgctggctgtttttgtctccggccacactcttggccttgctggtgtacagtatcgtcaagtaccagccctcggaatacggtagctatcgcttccccgcctgggccgagctgctaggcatcctgatgggcctgctctcctgcctcatgatcccagctggcatgctggtagctgtgcttcgagaggagggctcgctctgggagcgacttcagcaagccagccgtcctgctatagactggggcccatcactggaagagaaccggacgggcatgtatgtggccaccctggctgggagccagtcaccaaaaccactgatggtacacatgcgaaaatatgggggcatcaccagcttcgagaatacagccattgaggtggaccgtgagatcgcagaggaggaagaggagtccatgatgtgagaccagacacctccaaacaggagggctggtcggggcctccccgtctgtcccttccttggccacaggggatagctttgtctgttgggattctgacaggcaatgggaggttgccatggcaacgacagtccccagcctaagtccctctttgtggcctctacatctcctggaacctctagatggacatacatatactaggtaacccattcaaagctgaaacgattcagctcagccctcagtttgtgagggggtgcgttgaagccagggagagaagagctggaccaaggtgacatgcccaagaggacttgttcccaagcctcctccagccagtcaactccctttcccttgggggagcaagcaccatatctgacatctttgttcagacactttgacaagatacatttccatacaagccaactttaaaccccaggttcagggtagcgagaacctggagagccccaaggccctggatatagatagaatggcagcgaccaaattgggtagaaaagtctttgtgggttcctgtgttaaggccagttttcccagaagaagtgggagctttagggctgagaggtgtgaaagattgcagaagaggctagagggaaggtttgcgggtcagagctgcccctgagccaggaggaggcccaacctgccagagcagagaccaggaggggctggagattgtggtgctcccgggttatgagagggaataaagactcgcagggcc

SEQ ID NO: 4103 - DNA, 2142 bp, Rattus norvegicus
  Genbank Accession No. NM_053999
ggggccgccgtcgctgtcctagccgccgccgctgccgccgccgccgctgccgtcttcaccgcgggagaaggagcacgagacaggacgcccctgagtgaacgccaccatcctgccgacagctccgcccgggctgcttcctttccgcccaggtccccgtcccctcccccctcaggtgccatccgcctccatccgcgccctcgatccccccatccccaggtgagggggctgagccccggtcgcggaggcccggacgagcccggcagggtcaccatttgcagcgcgacatggcaggagctggaggagggaatgatattcaatggtgtttttctcaggtgaaaggagcagttgatgatgacgtagcagaagcagatataatttctacagtagagtttaatcattctggagaattactagccacaggagataaaggtgggagagtcgtcatctttcaacaagagcaggagaacaaaatccagtctcatagcagaggagaatacaatgtttacagcaccttccagagccatgagccagaatttgactacttgaaaagcttagaaatagaagagaagatcaacaaaattaggtggttaccccagaaaaatgctgcccagtttttattgtctaccaatgataaaacaataaaattatggaaaatcagtgaaagagacaaaagaccagaaggctataacttgaaagaggaagatggaaggtatagagaccctactacagtcactacactacgagtgccggtgtttaggcccatggatctaatggtggaggccagtccgcggagaatatttgccaacgcccatacctaccacatcaactccatttctatcaatagtgattatgaaacctacttatcagcagatgatttgcgaattaatctctggcatctggaaattacagacaggagttttaatattgtggacattaagcctgccaatatggaggagctcacggaggtgatcacagccgcagagttccatcccaacagctgtaacacgtttgtgtacagcagcagtaaagggaccattcgcttatgtgacatgagggcatctgcactctgtgacaggcattctaaactgtttgaagaacccgaagatcccagcaacaggtcgtttttttctgaaatcatctcctcaatttctgatgtaaaattcagccacagtggtcgctatatgatgactagagactatttgtcagtcaaagtttgggacttgaatatggaaaacaggcccgtggagacataccaggtacacgaatacctcagaagtaaactttgctcactgtatgaaaacgactgcatatttgacaaatttgaatgttgttggaatgggtctgacagtgttgtcatgactggatcctacaataatttcttcagaatgttcgacaggaacacaaagcgggatataactctagaagcatcgcgagaaaacaataagcctcgtacagttttgaaaccacgcaaagtctgtgcaagtggcaagcgaaagaaagatgaaataagtgttgacagtctagacttcaacaagaaaatccttcatacagcctggcatcccaaggaaaacatcattgctgtagcgactacaaacaatctgtatatatttcaagacaaagtgaattaggctggcattctctgcagaggagccacttcctgcttagtgagatagttgaatctagcattcgtacctataagagagcggtccattgtggcgtccctttccagtgtttgacagtgtgccattcaacaacacatttgatagccacatggagaaagctgtgcggatgcatcccgggctgtttccatgtctgctagccatttagggaagggaagggcacttttaatttaatgacttcttgcaccatcttgcctggtggactggactggactgtgtcagcattgatgtactccactttttatgccttccattgtgatgacgtcaaacacagtgaacgccttcagtcatgctatggaatttgtgtatcctcattactgtatcatttgtgggagtgcaagggtaatcatttattgaactgcaagagcaagatatttgtgcggaatgatcatgggtggggccaagagaaatttaagaaagcttttaattctcgatgtgttgtcctgggtaactagggaagatg

SEQ ID NO: 4104 - DNA, 1938 bp, Rattus norvegicus
  Genbank Accession No. NM_054001
ggccaggcgatcccagcacccgcgatcgcgcgctctgtgctccgagggccgtgctcgcctggtgcctactccagggctgtgtacaccgcgtcgggctcggctgagcccgcaccaggagggcgcgggagccgcagggccctggagctttgggcgactgctacgcggccttggccgaggctcttccttgctcgccgttctgtcgcgggcctggcccgtgaaccgctcacagtatggcccgatgctgcttctacacggcggggacactgtctctgctgctgctggtgaccagtgtcacgctgctagtggctcgagtctttcagaaggcagtggaccagacgatcgagaagaatatggtattacaaaatggtaccaaggtctttgattcctgggagaagccccctctacctgtgtacatccagttttatttcttcaatgtcaccaatccagaggagatcctccaaggagaaatccccctgctagaagaagtggggccgtacacctacagggagctcaggaacaaggcaaacgttcagtttggagaaaatggaacaaccatatctgccgtcaccaataaggcatatatttttgaacgaaaccagtctgttggagaccctaccgttgacttgattagaacaataaatattcctctgttgactgttgtggaaatggcccagcagcccttcctcagggagatcatcgaggccatgctgaaagcttatcagcagacgctgtttgtcactcacactgtacatgaactgctctggggctacaaagatgaggtcttgtcgctcgtccatattttcagacctgacgtctcccctaactttggcctgttctatgagagaaatggaactaatgatggggagtatgtttttctgactggagaggacaattacctgaactttacaaaaattgtggagtggaatggaaaaacgtcgctggactggtggacgacggacacgtgcaatatgatcaacgggacagacggagattcttttcacccattaataagcaaggatgagaccctgtacatcttcccatctgacttctgcaggtccgtctatataactttcagtagctttgagaacgtagaaggactgcctgcttttcggtataaggtgcctgcagaaatactagccaattcctccgaaaacgctggcttctgtatacccgagggaaactgcatggacgcgggagtgctgaacgtcagcatttgcaagaatggtgcgcccattatcatgtctttcccacacttttaccaagccgacgagaagttcgtttcggccataaaaggcatgcgtccaaacaaggaagaacatgagtcatttgtggacattaatcctttgacaggaattattttaagaggggccaagagattccaaatcaacacgtacgttaagaagctggatgactttgtggaaacgggaaacattaggactatggttttcccagtgatgtatctcaatgagagtgttctcattgacaaagagactgcaagtcaactgaagtctgtgattaacacaactttgattgtcaccaacataccctacatcatcatggcactgggcgtgttctttggcttgattttcacgtggctggcgtgtcgaggacaggggtctacggatgagggaactgcagatgaaagggcacccctcatacggacctaatgggacttacctgttgcctgagcttggtgagagaatgtgagaactgacctgacctggaccaggacagggaaaagcctgcatctcacgggctcctggcctgtcaagaagggagatgaagccgcagcactggcacgcgagaagaccctcctggacagaggggaccgagcaggtgacatggctggcaattacgctttataaaatcatgtctctgaaactgtgtcaatgtgtcttagggagtatttaataaattatatagaaacctttaaaaacc

SEQ ID NO: 4105 - DNA, 4383 bp, Rattus norvegicus
  Genbank Accession No. NM_054004
tctggcctcttgccctaagaagcgagtgcggagggagtgggagcgagactgcccgaacgcaagtgtctggcttcccggcgaggcccaggcgtccgtcccgccgcccatgaactcgttgccccgcgagcagcgccgtcgttaggccgtccccgtcactctcgctcgcccccatccccgggcagccattcccccctacccacgtctggccggggactggacgtcgtgtcgaagcgccttccccagtccgcgtcgcgctgcgaccctggaagcgggcgccgccgccaacgagaggaggagccccggccgcggggcccagcagccactgagccagcaggcgggatcgaggccggcaacatggcgagcgcttcgtaccacatctccaacttgctggaaaaaatgacatccagcgacaaggacttcaggtttatggctacaaatgatctgatgacagaactgcagaaagactccatcaagctggatgatgacagcgaaaggaaagtcgtaaagatgattctgaagttgctggaggataaaaatggcgaagtgcagaacttagctgtgaaatgtcttggtcctttagtgagtaaagtgaaagagtaccaagttgagacgattgtagacaccctctgtacaaacatgctttctgacaaggagcagcttcgagatatttccagtattggccttaaaacagtaattggagaactccctccagcttccagtggctctgcattagctgctaatgtatgtaaaaagattactggacgccttaccagtgcaatagcaaagcaggaagatgtttctgttcagctagaagctttagatattatggctgatatgttgagcaggcaaggaggactgcttgttaatttccatccttcaattctgacctgtctacttccccagctgactagccctagacttgcagtcaggaaaagaacaattattgctcttggccacctagttatgagctgcggaaacatagtttttgtagaccttattgaacatctgttgtcagagttgtccaaaaatgactccatgtcaacaacaaggacctacatacagtgtattgctgctattagtaggcaagctggccatagaataggtgaataccttgaaaagataattcctttggtggtaaaattttgtaatgtagatgatgatgaattaagagaatactgcattcaagcttttgaatcatttgtgagaagatgccctaaggaagtttatcctcatgtttctaccattataaacatttgtctaaaataccttacctatgatccaaattacaactatgatgatgaagatgaagatgagaatgctatggatgctgatggcggagatgacgatgaccaagggagtgacgatgaatacagtgatgacgatgacatgagttggaaagtgaggcgtgcggctgccaagtgcctggatgccgtagttagcacacggcatgagatgctcccggaattctacaagaccgtctctcctgcactgatatccagatttaaagagcgcgaagagaatgtaaaggcagatgtttttcatgcatacctttctcttttgaagcaaactcgtccagtacaaagttggctgtgcgaccctgatgcaatggagcaaggagaaacacccttaacaatgcttcagagtcaggttcccaacattgttaaagccctacataaacagatgaaagaaaaaagtgtaaagacccgacagtgttgttttaacatgttaactgaactggtaaatgtgttgcctggggcactaacccaacacattcctgtacttgtaccaggaatcattttctcactcaatgataagtccagctcatcgaatctgaagattgatgcattgtcctgtctgtatgtgatcctctgtaaccactctccgcaagttttccacccgcatgttcaggctttggtccctccagtggtggcttgtgttggtgacccattttacaagatcacatcagaagcccttcttgtcactcagcagcttgtcaaagtaatccgtcctctggaccaaccctcctccttcgatgcaacgccttacatcaaagatctcttcacttgtacaattaagcgcttaaaagcagctgacattgatcaggaagtcaaggagagggctatttcctgtatgggacagattatttgcaatcttggagacaatttgggccctgacttatcaaatacacttcagattttcttggagagactcaagaatgaaatcacccggctaacgacagtgaaagcactgaccctgattgctgggtcacctttgaagatagatctgaggcctgtgctgggagagggagtccctatccttgcttcatttctcaggaaaaatcagagagctttgaaactggggaccctctctgccctagatattctcattaaaaactatagtgacagtttgacggccgccatgattgatgcagttctggatgagctccctcctcttatcagcgaaagtgatatgcacgtgtcccagatggctatcagcttccttactaccctggcaaaagtatatccctcctccctttcaaagataagcggatctattctcaatgaactgattggacttgtaaggtcacctctgctgcagggaggagctcttagtgccatgctagacttcttccaagctttggttgtcactggaacaaacaatctaggatacatggatttgctgcgcatgctaacgggtccagtttactctcagagcacagctcttactcataagcagtcttactattccattgccaaatgtgtagctgcccttactcgagcatgccctaaagagggaccggctgtagtaggtcagtttattcaagatgtcaagaactccaggtctacagattccattcgtctcttagcgctcctttctctaggagaagttggacaccatattgacttaagtgggcagttggagctaaaatctgtaatattagaggctttctcctctcctagtgaagaagttaaatcagctgcatcctatgcgttaggcagcatcagtgtaggcaacctccctgagtatctgccatttgtactacaagaaataaccagtcagcccaaaaggcagtacctgctgctgcattccctgaaggaaatcattagctctgcgtcagtggtcggccttaagccgtatgtcgagaacatctgggccttgctgctaaagcactgtgagtgcgcggaggagggcaccagaaacgtcgtcgccgagtgtctagggaagctcactcttattgatcctgaaactctcctcccgaggcttaaagggtatttgatatcagggtcatcctatgccagaagctcagtggttacagctgtgaagttcactatttctgaccaccctcagcccattgatccactgctcaagaactgcataggtgattttctaaaaacgttggaagacccagatttgaatgtaagaagagtggccttggtcacattcaattctgcagcccataacaagccgtcactgatacgggaccttctggattctgttcttccacatctttacaatgagacaaaagttaggaaggaacttataagagaggtagagatgggcccgtttaagcacacggttgatgacggcctggacattagaaaggcagcttttgagtgtatgtacacacttctagacagctgtcttgacagactggatatctttgaatttctaaatcatgtggaagatggtttgaaggaccattatgatattaagatgctaacatttttaatgttggtgagactatctaccctttgtccaagtgcagtactacagaggttggaccggcttgttgagccactacgagctacgtgtacaactaaggtgaaggcgaactctgtaaagcaggagtttgaaaagcaggacgagttaaagcgctcggccatgagggcagtagctgcactgctcaccattccagaggcagagaagagccctctcatgagtgagttccagtcacagatcagctccaacccggagctggcagccatctttgaaagtatccagaaagattcttcgtccactaacttggaatcaatggacactagttagacgtgtgttccacatgaggaccattacatttgaccgcacagtgcactgaaccgacaagttgaccatagacacgggagagaagtgtctagagcttcaggatgttccacttttattttcattcatgggaagtttgttcagctttcttccattgttgtttttgtagcttttacttcagaaatctgtatttccataatccagaggttgtaagaccactgatggttttagtggttagggcaacgtttgaaatgggaactaaagtttggatttatggaatgtggaaatagggtccagtatctgtttgccctgtaatgtgtaggattaaaatgttaaaacttt

SEQ ID NO: 4106 - DNA, 3755 bp, Rattus norvegicus
  Genbank Accession No. NM_054006
gaattccttttttttttaatactagcaactttcattctttggaacttgtgctgaaaaaaagaagagtcagcaaatactactgaaagtgcaatattcgattatcactgcgagatgagctttgatccaaaccttctccacaacaatggacacaacgggtaccccaatggtacttctgcagcactccgtgaaactggggttattgaaaaactgctgacctcttatggatttattcagtgttcagaacggcaagctaggcttttcttccactgttcacagtataatggcaacctccaggacttaaaagtaggagatgatgtggaatttgaagtatcatctgaccggaggactgggaaacctattgctattaaattggtgaagataaaaccagaaatacatcctgaagaacgaatgaatggacaagttgtgtgcgctgttcctcacaacttagagagtaaatctccagctgccccgggtcagagtccaacagggagtgtatgctacgaacgtaatggggaagtattttatctgacttacacctctgaagatgtggaagggaacgttcagctggaaactggagacaaaattaactttgtaattgataacaataaacacactggtgctgtaagtgctcgtaacattatgctgttgaaaaagaaacaagctcgctatcaaggagtagtttgtgccatgaaggaggcgtttggctttattgaaagaggtgatgttgtaaaagagatattctttcactatagtgaatttaaaggtgatctagaaaccctgcagcctggagatgacgtggaattcacaatcaaggacagaaatggtaaagaagttgcaacagatgtcagactattgcctcaaggaacagtcatttttgaagatatcagcattgaacattttgaaggaactgtaaccaaagttatcccaaaagtacccagtaaaaaccagaatgacccattgccaggacgaatcaaagttgactttgtgattcctaaagaacttccctttggagacaaagacacaaaatccaaagtgaccctgctggaaggtgaccatgttaggtttaatatttcaacagaccgacgtgacaaattagaacgagcaaccaacatagaggttctatcaaatacatttcagttcactaatgaagccagagagatgggtgtgattgctgccatgagagatggttttggcttcatcaagtgtgtggaccgtgatgctcgtatgttcttccacttcagtgagattctcgatgggaaccagctccacattgcagatgaagtggagtttactgtggtccctgatatgctctctgcccaaagaaatcatgctattaggattaaaaaacttcccaagggcacggtttcattccattcccattcagatcatcgttttctgggcaccgtagaaaaagaagccactttttctaatcctaaaactacaagcccaaataaaggcaaagacaaggaggcagaagatggcattattgcttatgatgactgtggggtgaaactgactattgcttttcaagccaaggatgtggaaggatctacttctcctcaaataggagataaggttgaatttagtattagtgacaaacagaggcctggacagcagattgcaacttgtgtgagacttttaggtcgtaattctaattccaaaaggctcttgggttatgtggcaactctgaaagataattttggatttattgaaacagctaatcatgataaggagatatttttccattatagtgagttctctggtgatgttgatagcctggaactgggagacatggttgaatacagcttgtccaaaggcaaaggcaataaagtcagtgctgagaaagtaaacaaaactcactcagtgaatggcatcactgaggaagcaaatcccaccatctactctggtaaagtcattcgtcctctgagaggcgttgatccaacacagattgaataccaaggaatgattgagattgtggaggagggggatatgaaaggtgaagtgtatccttttggcatagttgggatggccaacaaaggggattgcctacagaaaggggagagtgttaagttccagttgtgtgtacttggccaaaatgcacaaactatggcctacaacatcacaccccttcgtagggctactgtggagtgtgtgaaagatcagtttggctttattaactatgaagtaggagatagcaagaagctctttttccatgtgaaggaagttcaggatggcattgagctacaggcaggagatgaggtggaattctcagtgatccttaatcagcgcactgggaaatgtagcgcctgtaatgtttggcgagtctgtgaaggccccaaagctgttgcagctcctcgacctgatcggttggttaatcgcttaaagaacatcaccctggatgatgccagtgctccacgtctaatggttcttcgtcagccaaggggaccagataactcaatgggatttggtgcagaaagaaagatccgtcaagctggtgtcattgactaaccacgtccacaaagcacatcattaatccactatggtcaagttggggggattctggtgaagggttctgaatatcttcctcttcatccctcccaaaatctggaatacttattctattgagctattacaccagttttaacaccttcctcgtgttatgtttaaagaaaaaataaataaatttaagaaaccattttaaaattatgcacagttgcagcctggaaaacttaaggtggcgccttatagtgtcaatttaggagctttatttggtgcatttaacgcaactggtaattgcaaattccacttggcctgtgtaagtgaacaaaacagactgttactttgttggccctatgaaattctgcactctagtcagtatatatactctaccttcatgacttaatactcagctgcattcttttccttttttccctctgttcattatgctttaattctgaggaccatatgaaggtagaatatattacctttaaaaattgcaaaatttatatagcaaacgattttcttaagttgatggccaaatgttaaaatgttattttcatatcatttataatcttgtcacaatccacttaacgaagtttgattacatttcagtgaaaattatcttccataataggttttttttttccttcctgggatggggggcaaataactttactacaattagtatgtatggtgcagaatttcatgcaaatgaagtgtgccagcagtgtgataatttaaacatatttaaacaaaagacgaatgcacaaaattgctgctgcttagatcactgcagcttctaggacccagtttcttttactgatttaaaaacaaaatgaaaaaaaaataataaaaaagttgtgcctgaaatgaatcctgttttttttataagtagccccctggttccagtgccctgttgaatacaggcacttgatccttggtgcagcttctgttcaactttgtatcacgggaacggattggcctgatttcttggccttcctcttgaattggccccaaacagggtccctggcaagtggagtgaaggctttttgtctaaagatgacaagggtcagctcaggggttgtgggggagggcgttttcatcttccccgttgtcacttgaggttttgaactctgggtaaagaggccgtttatctttgtaaacacaaaacatttttgctttctccggtttcatgttaatggcgaaagaatggaagcgaataaagttttactgatttttgaaaaaaaaaggaattc

SEQ ID NO: 4107 - DNA, 1742 bp, Rattus norvegicus
  Genbank Accession No. NM_057097
gagccgcgcactcgagggagcttctgccgccgccgccgccgccgccgccgccgccgccgccgccgccgccgccgccgccgccgccgccgccgccgccgccgaaatgtctacaggggtgccttcagggtccagtgctgccactggcagtaatcgaagactccagcagacacagaatcaagtagatgaggtggtggacatcatgagagtcaatgtggataaggtgttagaaagagaccagaagctctcagagctagacgaccgcgcagatgcactgcaggcaggcgcctcgcagtttgaaacaagtgctgccaagttgaagagaaagtattggtggaagaactgcaagatgtgggcgatagggatcagtgtcctggtgattattgtcattatcatcattgtgtggtgtgtctcttaatgaagaacagaggaaatgaagcctgacggcaggatcttcttcgagactttctacttagaactgcgtgttgtcgcacttcccatgattatttgtgttagtttacatacagttcagtgcctagatgttttttttttttttcccaaaaatgtgcctttgtttttcatatacactcgaggtgtgacctgccctgcccacattttgcacagtgcctttacagatttatggactgggaaagaggacttgtgtgtttcagagtgctgagatctaggtggatgttgtcactgatggcttgtggattcaaggaagaggattttgttcaagtcagctgtccccacacctaacatggacttcaaaaccacagtttaaacctttgggtaattagattcccaacttggaccttccaagaagaacactactgcctaacaaaaatcagtgacaacagcagggcgtgccttattttgataactaggtaacttttcattaagagtacttttgtaagcactaccgaccccgctgtatttaagatgctggtgaagagctcatgctcttatgttagatacggagatgttcactttctagttcttgttgtgtatcacttctaaaacagtattttaatcagaaataaccctttaggaagtttttatagaactgtgaccaaagtttctattttgccaaaagttaaatacaaatgaattgtccataagtttgtcccccagtagtaaattcaaataagtgccaagtgtaactcaaggtgccctttaagaaaaaatgttagtactgtctgagcccgcagcatcttgacagtccttcctgtggaatgctgtaggtacagcttctcatcctgatgtggtttctttcctagagctatagaggtgacctcaaatcacacctgtatgcaagatagtagtttgcagactgcactagcctgtggccactagtgtgatgagagcagcatctgaagcctcacaaaggcaacagtctgcacagagttctgggagactgtggcagtgccaccaggatgtcctgaaatgtgtgtctgtgtgcaaagcagcattagccaaaatgtcataggatctggttctagttttttttatctgatcccctaacattaccgaaacaaaacaagtgttgaagacatgccttgccacatagctagggcctctgtcctggtctgaccccacaactttggtgctgtctcctcgtactctgtcccatgtaagtcgttggctcctgtattaacacagtaatacctcgcttctctgtgcatttagctgggaatgttcccgctatggtgaccggaataaagttattaacatgaaaaaaaaaa

SEQ ID NO: 4108 - DNA, 760 bp, Rattus norvegicus
  Genbank Accession No. NM_057099
gcggccgccttagctgttcgtggagccgtctctgcaccggcctttgggccggaggcgctcactccagactgggaaaaccgagaagtctccacagggaccacgatcatggctgtgcaatttgacgggggcgtggttctaggagcagactccagaacaaccactgggtcgtacatcgccaatcgagtgactgacaagctgacccctatccacgatcacatcttctgctgccgctcaggctcggcagctgatacccaagcagtagctgatgctgtcacgtaccagcttggtttccacagtattgagctgaacgagcctccactagtgcacacagccgccagtctctttaaggagatgtgttaccgctacagagaagatctgatggcaggaatcatcatcgcaggctgggaccctcaagaaggagggcaggtgtactctgttcccatgggaggtatgatggtaagacagtcctttgccatcggaggctccgggagctcatatatctatggctatgttgatgctacctatcgggaaggcatgaccaaggatgaatgtctgcaattcactgccaatgctcttgctttggctatggaacgggatggctccagtggaggagtgatccgcttggcagccattcaacagtcgggggtagagcggcaggtgcttttgggagaccagatccccaaggtcaccatctccactttgccacctccctgaagcctaggattcccatcccgacgcacaagctaataaacagattgtc

SEQ ID NO: 4109 - DNA, 2573 bp, Rattus norvegicus
  Genbank Accession No. NM_057100
ccgggctcccggcccgggcctcgccatgccgccaccgcccgggcccaccgccgccctgggcactgcgcttctgctgctcctgctggcctccgagtcttcgcacactgtgctgttgcgggcgcgtgaggcggcgcagttcctgcggcccaggcagcgccgcgcctaccaagtcttcgaggaggccaagcagggccacctggaacgggagtgcgtggaggaggtgtgcagcaaggaggaggctagagaggtgttcgagaacgaccccgagacggactatttctatccaagatatcaagagtgcatgaggaaatatggccggcccgaagataaaaacccaaatttcgccacctgtgttaagaacttacctgaccaatgcaccccaaacccctgtgataagaagggcactcaactctgccaagacctcatgggcaacttcttctgcttgtgcaaagatggctggggaggccggctctgtgacaaagatgtcaacgagtgtagtcagaagaatgggggctgcagccaggtctgccataacaaaccaggaagcttccaatgtgcctgccacagtggcttctcacttcaatcagacaacaagagctgccaagatatagatgaatgcacagactcagacacctgtggggatgcgcgttgcaagaaccttccgggctcctactcctgcctctgcgacaaggggtacacttacagctccaaggagaagacctgccaagatgtggatgagtgccagcaggaccgttgtgagcagacctgtgtcaactccccaggcagctatacctgccactgtaatgggcgcgggggcctaaaactgtccccagacatggatacctgtgaggacatcttaccgtgtgtgcccttcagcatggccaagagcgtcaagtccttgtacctgggccgcatgttcagcgggacccccgtgattagactacgcttcaagaggctccagcctaccaggctgctggccgaatttgacttccgtacttttgaccctgagggagtcctcttcttcgccggaggtcgctcggatagcacctggatcgtcctgggcctcagggctgggcgacttgagttgcagctacggtacaatggcgttggacgcatcaccagcagtgggccaaccatcaaccacggcatgtggcaaacgatctctgtggaagaactggaccgcaaccttgtcatcaaggtcaacaaagatgccgtgatgaagattgcggtggctggggggctgttccagctagagagaggcctgtaccacctgaatctcactgtggggggcattcccttcaaggagagtgacctcgtccagccgattaaccctcgcctggacgggtgcatgaggagctggaactggctgaatggggaagacagtgccattcaggaaacggtcaaggccaatacaaaaatgcagtgcttctctgtgacagagaggggctccttcttcccggggaatggatttgccttctatagcctcaactacacccggacatcgctggatgtcggcacggaaaccacctgggaagtagaagtcgtggctcgcattcgccctgccactgacacgggggtgctgatggcactggtgggggacaaagacgtcgtcctcctctctgtggccctggtcgactaccactccacaaagaagctcaagaagcagctggtggtcctggcagttgagaatgttgccctggccctgatggaaatcaaggtgtgcgacagccaggaacacactgtcactgtctccctgcgggatggcgaggccaccctggaagtggatggtaccaagggccagagcgaagtgagcaccgcacagctgcaggagcgactggacctgcttaagacacgtctgcaaggctccgtgctcacctttgtggggggcctgccagatgtacaagtgacttccacacccgtcacggcgttctaccgtggatgcatgactctggaggtaaacgggaagaccctggacctggatacggcctcctacaagcacagtgacatcacctcccactcctgcccgcctgtggagcacgtcacagcctagaccgagctgcaagagttctctacacctaaaagacacggtgaagcagggtcagggacacacagcaccatctcctctcgcatgggccctgcaacactggagcaggtgcagggctacgatgggtactacgtactgtccgtggagcagtaccccgagctggctgacagtgccaacaacatccagttcctgagacaaagcgagatcggcaagaggtaacccccgggccacccctgcgcagattctcctgtagcacaaaccgaaccggactctccaaagagccttccagaatgacactgctctgcagacaccctcggcgcagacacaggcaacacaaaccagaaacaaagacgactttttttttctctaaatgaccttaaaggtgatcggctttaaagaatatgtttacatacgcatatcgctgcactcaattggactggaagtatgagaaggaaaaaaaagcattaaaaaggcaacgttttgccatgaccctctgtaccttcgaggcactgtatttaacaaaagtttt

SEQ ID NO: 4110 - DNA, 1964 bp, Rattus norvegicus
  Genbank Accession No. NM_057101
ggttgggccatgctgctacctgggctgctgttgctgctgctgctgctgctgctagctggcacccgctggctgtggggtcagtggaagctctggaaactccgcctcccgcctctggccccggggtttctgcactttctacagcccaaccttccggtctacctgtttggcctggctcagaaacttgggcccatctacaggatccgcttggggctacaagatgtggtggtgttgaactctaacaaaaccattgaggaggccttgatccaaaagtgggtggactttgctggccgaccccagatactagatggaaagatgaactttgacctctccatgggggattattctctaacatggaaagcccacaagaaactctctcgttcggccctggtgctgggcatgagagactccatggaacctctggtagagcagctgacccaggaattctgtgagcgcatgagagcccaggccggtgcctctgtggccatccataaggaattctccttactcacctgcagtatcatcagctgtctcactttcggagacaagcaggacagcactttgctgaatgccactcacagctgtgtccgggacttgctgaaagcctggaatcactggtccgtccaaatcttggatataattccctttctcaggttcttccccaatccaggcctctggaaactgaagcagttccaggagagtagggaccatatcgtaatgcaggagctgaagaggcacaaggacagcctggtggcagggcagtggaaagacatgattgactacatgctccagggtgtggagaagcaaagagatgccagagacccagggcagctccacgagcggcacgtgcatatgtcggtggtggacctttttgtcggtggcacggagaccacggctgccacgctctcctgggctgtggctttcctgcttcaccaccctgagatccagaagcggctgcaggaagaattagacctcaagctggcccccagctcccagctcctgtacaagaaccgaatgcagctacctctgctcatggccaccattgctgaagtgctgcgtttgcggcccgtggtgcccatggccttgccccatcgtgcaactaaggctagcagcatctctggctatgatatccccaaggatacgatcatcatccccaacatccaaggcgccaacctggatgagatggtttgggaactgcccagcaagttctggcctgatcgcttcctggaatccggcaagagtcccagaataccgacctttggctgtggggcacgcgtgtgcctgggcgagcctctggcgcggctggagttcttcgtggtgctggctcgcctgctccagaccttcacgctgctgccgccaccagatggtaccctgccctccctgcagcccctgccgtatactggcatcaatctcttaattcctcccttccaggtgcggctgcagcccaggaacctggcaccccaagaccagggccagaaatcctcgacaggataggacgagccttgtgcctcagtttctcctttattgctccattcccctcccctcccccctgtaaacatggtgctgtgagactgtggcagagaaggcttcctcggtgagctaggcacagtagagacacactggctcttctctgggcacaacccctcagtgctcggcagtcataccagggtgtgagtgaggtgggcagcaggctcaggtgcccctggtgggggcctggaagtttctgggtctcagcttcatttccgtgaagggcaccgagaactcgaagcccttccagtggtaccagctcactccctgagggaagggttgtcaagggaggagagtcaagacaacgccacatctatgccaccttatccatcccaaccctggctcctctaggtgactcccagagtgcagccatctccccccatgatccctgaagtgatgtcctctcccacccgctaataaacggtcttttcaagattccc

SEQ ID NO: 4111 - DNA, 3216 bp, Rattus norvegicus
  Genbank Accession No. NM_057104
ggtacccaacagcctgaactcagagccccgagagcagagcattcagggcaagcagaaacaccctgcagaggctttccaagaatccctcggcatggcaagacaaggctgtctcgggtcattccaggtaatatccttgttcacttttgccatcagtgtcaatatctgcttaggattcacagcaagtcgaattaagagggcagaatgggatgaaggacctcccacagtgctgtctgactctccatggaccaacacctctggatcctgcaaaggtagatgctttgagcttcaagaggttggccctccagactgtcggtgtgacaacctgtgtaagagctacagcagctgctgccacgatttcgatgagctctgtttgaaaacagtccgaggctgggagtgcaccaaagacagaagtggggaagtacgaaacgaggaaaatgcctgtcactgcccagaagactgcttgtccaggggagactgctgtaccaactaccaagtggtctgcaaaggagaatcacactgggtagatgatgctgcgagaaatcaaagttccgaatgcctgcaggtttgtccgcctccgttaatcatcttctctgtggatggtttccgtgcatcatacatgaagaaaggcagcaaggttatgcccaacattgagaaactgcggtcctgtggcacccatgtcccctacacgaggcctgtgtaccccacaaaaaccttccctaatctatatacgctggccactggtttatatccggaatcccatggaattgtcggtaattcaatgtatgatcctgtctttgatgcttcgttccatctacgagggcgagagaagtttaatcataggtggtggggaggccaaccgctatggattacagccaccaagcaaggggtgagagctggaacattcttttggtctgtgagcatccctcatgaacggaggatcctaaccattcttcagtggctttctctgccagacaacgagaggccttcagtttatgccttctactcagagcagcctgatttttctggacacaagtacggcccttttggccctgagatgacaaatcctctgagggagattgacaagaccgtggggcagttaatggatggactgaaacaactcaggctgcatcgctgtgtgaacgttatctttgttggagaccatggaatggaagatgtgacatgtgacagaactgagttcttgagcaactatctgactaatgtggatgacattactttagtgcctggaactctgggaagaattcgagccaaatctatcaataattctaaatatgaccctaaaaccattattgctaacctcacgtgcaaaaaaccggatcagcactttaagccttacatgaaacagcaccttcccaaacggttgcactatgccaacaacagaagaattgaagacatccatttattggtcgatcgaagatggcatgttgcaaggaaacctttggacgtttataagaaaccatcaggaaaatgttttttccagggtgaccacggctttgataacaaggtcaatagcatgcagactgttttcgtaggttatggcccaacttttaagtacaggactaaagtgcctccatttgaaaacattgaactttacaatgttatgtgcgatctcctaggcttgaagcccgctcccaataatggaactcatggaagcttgaatcacctactgcgtacaaatacctttaggccaaccatgccagacgaagtcagccgacctaactacccagggattatgtaccttcagtccgagtttgacctgggctgcacctgtgacgataaggtagagccaaagaacaaattggaagaactcaataaacgtcttcataccaaaggatcaacagaagctgaaaccgggaaattcagaggcagcaaacatgaaaacaagaaaaaccttaatggaagtgttgaacctagaaaagagagacatctcctgtatggacggcctgcagtgctctatcggactagctatgatatcttataccatacggactttgaaagtggttatagtgaaatattcttaatgcctctctggacatcgtataccatttctaagcaggctgaggtctccagcatcccagaacacctgaccaactgtgttcgtcctgatgtccgtgtgtctccaggattcagtcagaactgtttagcttataaaaatgataaacagatgtcatatggattcctttttcctccctacctgagctcctccccagaagctaagtatgatgcattcctcgtaaccaacatggttccaatgtaccccgccttcaaacgtgtttgggcttatttccaaagggttttggtgaagaaatatgcttcagaaaggaatggagtcaacgtaataagtggaccgatttttgactacaattacgatggcctacgtgacactgaagatgaaattaaacagtatgtggaaggcagctctatacctgtccccacccactactacagcatcatcaccagctgcctggacttcactcagcctgcagacaagtgtgacggtcccctctctgtgtcttccttcatccttcctcaccgacccgacaatgatgagagctgtaatagctccgaggatgagtcgaagtgggtagaggaactcatgaagatgcacacagctcgggtgcgggacattgagcacctcactggtctggatttctaccggaagactagccgtagctattcggaaattctgaccctcaagacatacctgcatacatatgagagcgagatttaactttctgggcctgggcagtgtagtcttagcaactggtgtatatttttatattgtgtttgtatttattaatttgaaccaggacacaaacaaacaaagaaacaaacaaataaaaaaaaaaaccacttagtattttaatcctgtaccaaatctgacatattaagctgaatgactgtgctattttttttccttaattcttgatttagacagagttgtgttctgagcagagtttatagtgaacactgaggctcacaatccaagtagaagctacgtggatctacaaggtgctgcaggttgaaaatttgcattgaggaaatattagttttccagggcacagtcaccacgtgtagttctgttctgttttgaaagactgattttgtaaaggtgcattcatctgctgttaactttgacagacatatttatgccttatagaccaagcttaaatataataaatcacacattcagatttt

SEQ ID NO: 4112 - DNA, 1593 bp, Rattus norvegicus
  Genbank Accession No. NM_057105
atggcttgccttcttcctgctgctcgacttcctgcaggctttctcttcttagtgctctggggctcagttctaggtgacaagctgctggtggtcccccaggatggcagccactggcttagcatgaaggagatagtggagcacctcagtgaacgcggacacgacattgtggtgctagtgccagaagtcaatttgcttttgggagaatccaaatactacaggaggaaaagcttcccggtcccctacaacctagaagagttgcggacccgctatcgctcctttgggaacaaccactttgctgccagttcccccctgatggctcctctaagagagtacaggaacaacatgattgtcattgacatgtgctttttcagctgccagagcctcctgaaggactcggccaccctcagcttcctcagggagaaccagtttgatgctctgttcacagacccggccatgccctgtggtgtgatcctggctgagtatctcaagctgccttccatctacctcttcagaggtttcccatgctctctggagcacatgcttggtcaaagcccaagccccgtatcctatgttcccagattctacaccaaattctcagaccacatgacatttccccaacggctggccaacttcattgctaacatcttggagaactacctttatcattgtctgtactcaaagtatgagatccttgcctcagacctcctcaagagagatgtgtccctacctgccttacaccagaactctctgtggctgttacggtatgattttgtgttcgaatacccccggccagtcatgcccaacatgatcttcattggagggaccaactgcaagaagaaggggaacctgtctcaggaatttgaagcctatgtcaacgcctccggagaacatggcatcgtggttttctctttgggatccatggtctcagagattccagagaagaaagcgatggaaatcgctgaggctttgggcagaattcctcagacggtcctgtggcgctacaccggaactagaccatcgaaccttgcaaagaacactattcttgtcaaatggctaccccaaaacgatctgcttggtcatccaaaggctcgggcgttcatcacacactccggttcccatggtatttatgaaggaatatgcaatggggttccaatggtgatgatgcccttgtttggtgatcagatggacaacgccaagcgcatggaaactcggggagctggggtgaccctgaatgtcctggaaatgactgccgatgatttggaaaacgcccttaaaactgtcatcaataacaagagttacaaggagaacatcatgcgcctctccagccttcacaaggaccgtcctatcgagcctctggacctggctgtgttctgggtggagtacgtgatgaggcacaagggggcgccacacctgcgccccgccgcccacgacctcacctggtaccagtaccactccttggacgtgattggctttctcctggccatcgtgttgacggtggtcttcattgtctataaaagttgtgcctatggctgccggaaatgctttgggggaaagggtcgagtgaagaaatcacacaaatccaagacccactga

SEQ ID NO: 4113 - DNA, 2779 bp, Rattus norvegicus
  Genbank Accession No. NM_057107
tgtaaaacttgattcccgttgagatctgttgattgtatttttgagcacatgaataaccacgtatcttcaacaccgtctaccatgaagctaaaacaaaccatccaccccatacttttatatttcatacattttataatatcactctatactattttaacatacatcccattttattttttgtgtgagtcaaaacaagagaaaccaaaccacattaaagcaaagcctgtcagttcaaaaccggactctgcatacaggtctgtcaacagtatggatggcttagcttcagtattgtatcctggctgcgacacacttgataaagtttttatgtatgcaaaaaacaaatttaaggacaaaagactattgggaacacgtgagattttgaatgaggaagatgaaatacaaccaaatggaaaggtttttaaaaaggttattctggggcactataattggctttcctatgaagatgtcttcattcgagccctcgattttggaaatgggttacaaatgttgggccagaagccgaaggccaacatcgccatcttttgtgagaccagggctgagtggatgattgctgcgcaggcgtgtttcatgtacaacttccagcttgttacactgtatgcgactctgggaggtccagccattgtccatggactgaatgagacagaggtgaccaacatcattactagtaaagaactcctgcaaacaaagctgaaggatatcgtctctttggtcccacgtctgcggcatatcattactgttgatgggaagcctccaacctggtctgagttccccaagggcgtcattgtacacaccatggctgcagtgcaggctctaggagtaaaggctgacgtggacaagaaagctcacagcaaaccactgccctcagatattgcagtaatcatgtacacaagtggatccacaggaattccaaagggagtcatgatctcacacagcaacatcattgcctctataacggggatggcgagaaggattccaagactgggagaggaagatgtatacattggatatttgcccctggcacatgttctagaattaagcgctgagcttgtgtgtctttctcatggatgccggattggctactcttcaccacagacattagcagatcagtcttcaaaaataaagaaaggaagcaaaggagacacatccgttctgaagcccacgctgatggcagctgtgccggaaatcatggatcggatctacaaaaatgtcatgaataaagtgaatgaaatgagtgcttttcaacgaaacttgtttattttggcatataattataagatggagcagatttcaaaagggtgtagtaccccgctgtgtgaccgctttgttttccggaatgtccgaaggctgctgggtggaaatattcgcgttttattgtgcggtggtgctccactttctgcaacgacacagcgattcatgaatatctgcttctgttgtcccgttggccaggggtatggactcacagaatctactggggctggaacaattacagaagtgtgggactacaataccggcagagtgggagcaccattagtttgctgtgaaatcaaattaaagaactgggaggaaggtggctattttaatactgacaaaccacatcccagaggtgaaattctgattggtggccaaaatgtgacaatggggtactacaaaaatgaagcaaaaacaaaggccgatttctttgaagatgaaaacggacagaggtggctgtgcactggcgatattggagagtttgaccctgatggctgcctcaagatcattgatcgtaaaaaggaccttgtgaaactacaggcaggagagtatgtttctctaggcaaagttgaggcagctttgaagaacctcccactgatagataacatttgtgcatatgcaaacagttaccattcttacgtaattggatttgttgtgccaaatcaaaaggaacttacggagctagctagaacgaaaggatttaacggaacttgggaagagctgtgtaacagcagtgaaatggaaaacgaggtccttaaagtgctttctgaggctgctatttcagcaagtctggaaaagtttgaaatcccactgaaaattcgtttgagccctgacccatggactcccgaaactggtctggtgactgatgccttcaagttgaaacgtaaagaacttaaaacacactaccaggcagacattgagcggatgtacggaagaaaataattagtttgggcattggtttgctacagtgagctcagatcaaatagggaaatacttgaaatgtatgtctcaggccaaggcaaactccattcctcatattaaaccctggctgttacttctcactacgtcaccatttttaactgacaggattagtaaactattaagacagcaaacatgtgtctgtctctgttttttcccctcctccagtttgctttggcatctatgactgtgtttgtcaataggagactttttcaaaatcatactggggaagcagtgattttaaaacctcaagtttttaaacatgatttatatgttctgtacaattgttcagtttgtaactttttaaagtttggatgtatagaaggataaataggaaatataaaaattggttatttgggggcttttttacttattgtatttaaaaataaaagggtatcaatgtgaaattatgtaaattttaaatgcttatgaatcaaatcattgttgaacaaaagatttgttgctgtgtaattattgtcttgtacgcatttaagagaaataaatatactcagacttatgttttaagaaatgg

SEQ ID NO: 4114 - DNA, 882 bp, Rattus norvegicus
  Genbank Accession No. NM_057114
ggctcacggttggttctgtttgtgagacctgtagctcgactctgctgatagcaagatgtcttcaggaaatgcaaaaattgggcatcctgctcccagcttcaaagccacggctgttatgccggatggacaattcaaagatatcagcctaagtgattacaaaggaaaatatgttgtattctttttttaccctcttgactttacttttgtgtgtcccacggagatcattgctttcagtgatagagcagaagaatttaagaaactcaactgccaagtgattggagcttctgtggattctcacttctgtcatctggcatggattaacacacccaagaaacaaggaggattgggacccatgaacattcccttggtatcagatcccaagcgcaccattgctcaggattatggagtcttaaaagctgatgaaggtatctctttcaggggcctctttattattgatgataaaggtatccttcgccagataacaataaatgatcttcctgttggccgctctgtggatgagattctgagactagtccaggccttccagttcactgacaaacatggtgaagtgtgcccagctggctggaaacctggcagtgataccatcaagcctgatgtcaataagagtaaagagtatttctctaagcagaagtgagcactggaccagttttctggcagacagctttgagcagccagaagaaatttgtactctacacatgacgtggtgtgattccagataagcctttcctacaagggctaggggtggttagcctttcttccactattggtaaggggcagaccatcttatatcagtcacagaaaccaacctgttaattctctctctctcttttttttttttaagtatctattaaacgtgaattc

SEQ ID NO: 4115 - DNA, 1344 bp, Rattus norvegicus
  Genbank Accession No. NM_057116
atgggcgaggacacggacacgcggaaaattaaccacagcttcctgcgggaccacagctatgtgacagaagctgacgtcatctccactgtcgagttcaaccacactggggaactgctggccacaggtgacaagggtggccgggtggttatcttccagcgggaaccagagagtaagaatgcacctcacagccagggtgagtacgatgtgtacagcaccttccagagccacgagcctgagtttgactacctgaaaagcctggagatagaggagaaaatcaacaagatcaaatggctcccgcagcagaacgccgcccactcgctgctgtccaccaatgataaaactattaaattatggaagattaccgagcgagacaagaggcccgagggctacaacctgaaggatgaggaggggaagctgaaagacctgtccacagtgacgtcactgcaggtgcctgtgctgaagcccatggacttaatggtggaagtgagcccgagaaggatctttgccaatggccacacctaccacatcaactccatctccgtcaacagcgactgcgagacgtacatgtcagcggacgacctgcgcattaacctctggcatctggccatcactgatcggagcttcaacatcgtagacatcaagccagccaacatggaggacctcacggaggtgatcacagcatctgagttccatccgcaccactgcaacctcttcgtctacagcagcagcaagggctccctgcggctctgtgacatgcgggcagctgccctgtgcgacaagcactccaagctctttgaagagcccgaggaccccagcaaccgctccttcttctcagagatcatctcctcggtgtccgacgtgaagttcagccacagtgggcgctacatgctcacgagggattacctcactgtcaaggtctgggacctgaacatggaggcgaggcccatagagacctaccaggtccatgactacctgcggagtaagctctgctccctgtatgagagtgactgcatcttcgacaagtttgagtgtgcctggaatgggagtgacagtgtcatcatgacaggggcctacaacaacttcttccgaatgtttgaccgcaacaccaagcgggatgtgacgctggaggcctcgagggagagcagcaaacccagagcggtgctcaagccaaggcgcgtgtgtgtgggtggcaagcggcggcgtgatgacatcagtgtggacagcttggacttcaccaagaagatcctgcacacggcctggcacccagcggagaacatcattgccattgcagccaccaacaacctgtacatcttccaggataaggtcaattctgacatgcactag

SEQ ID NO: 4116 - DNA, 1978 bp, Rattus norvegicus
  Genbank Accession No. NM_057119
gtggtgcggagcgagtcgactttggactactctcttagcgtggcgtcgcgcgaggctgcggcggagcctctgtcaggaaggcgggagcttgacagcttcagtaaagaccagcagcggtgacagcaacccggagtcatgagcgacagcggcgagcagaactacggcgagcgggaatcccgttctgcttcccgaagtggaagtgctcatggatcggggaaatctgcacggcacacacctgcaaggtctcgctccaaggaagattcaagacgttctagatcaaagtcaagatccagatctgaatctaggtctagatccagaagaagttctagaaggcattatacaaggtcacgatcacgatctcgctctcatagacgatcccggagcaggtcttacagccgagactatcgcagacgccacagccacagccattctcccatgtctactcgaaggcgtcatgttgggaaccgggcaaatcctgaccccaactgttgtcttggagtgtttggattgagcttgtacaccacagaaagagatctaagagaagtgttctctaagtatggccccattgctgatgtgtctattgtgtatgaccagcagtctagacggtcaagaggatttgcctttgtatattttgaaaatgtagatgatgccaaggaagctaaagaacgtgccaatggaatggagcttgatggacgtcggattagggtcgatttctctataacaaaaaggccccataccccaacaccaggaatttatatggggagacccacttatggcagttcacgacgccgggactattatgaccgaggatatgatcggggttatgatgaccgggactattacagcagatcatacagaggaggaggtggaggaggaggtggatggagagcagctcaagatagagatcagatttacagaaggcggtcaccttctccttactacagtcgtggaggatacaggtctcgttctcgatcaagatcctactcacctcgtcgctattaaagcatgaagttgaagactttctgagacctgccatagagctgggatgttgtttgtggacaatattttctattgtctcctgtttaaaaagtgaacagtgcctagtgaagttaggtgacttttacaccttttatgatgactacttttggtggagttgaaatgctgttttcattctgcatttgtgtagttcggtgctttgttcaaagttaagtgttttcagaaaagtatgttttgcatgtatttttttacagtccaaattttgactgctgagaagtttctattgtacaaaacttcatttaaaaggtttttctactgaatccagggtattctgaagatcgaagcctgtgtgtaaaatgctaccagatggcaaaaagcaacaataaacaagtttgatttttacttttctttctaaatatcaatgcttaacaagaaccattcttaagttatcagtaaaaaataaataaataaaaattttctttcaggagtccatgaaacttgccatattcgatatacctgcaattaagtgttaaaaatacgctgtaactctgtactgctagtattagaacaagaatctttccatacagctaatgcttaatgcttacattaatgtggatttgtcggcctttatgtaatctgtattatatatagcaggggataagagctacagatagatacatgcctttaaaaggctgtttcttaaggctgttacaaggagataatggtatttcaactaatcagcaagtgacaatacattccaccacaaatgtactcttgttcttctagcctttagactatgaaaatactgggtgcttcaaagtatggaatgagagaagggatcaccacacctgtgtcatggatgaagactgcctgttcattttttaaatatgattttcaggtcctttgcttaccaaaggaagcccaattcactcaaatgttttgagaactgtttaaataaacaagcaagaaaaattgctgatgc

SEQ ID NO: 4117 - DNA, 5253 bp, Rattus norvegicus
  Genbank Accession No. NM_057130
gtccagggaggctcctccgcacgccatgtgcccgtgtccccggcatcgcggccgcgggcccccggccgtgtgcggttgcggcgacgctcgccccgggctgcgctgggcggcggcgcaggtgaccgcgctgcggctgcaggcgctgggcgacgagctgcaccgacgcgccatgaggcgtcgcgcgcggccccgggacccgctgcccgcgctgctgcccgcgctccgcgcccgctggccctggctgtgcgcggccgcgcaggtggcggcgctggcggcctggctgctcggcaggcggagcgcgtaggcggcgcgcgcggggccttcttggtgggggggaccggagccgagacccagcccggaccgagcaacaggttggcgaaaccctgtgtccttggaggaagctggttcctgttttcctgagggagtagcccggagtgcggaaggaagccaagagtgtacagagttgatggtgggaacgcgggcagaggaagcccctcgggaagtccagctgcagagatagccacctcagtgctatttacatagagctatatatatacaaaacaggagaaaaatacaaaattccgtatctgtgcatgcctgcgggggacgtggtccctttcctttccacgcaaccttgcgatgtgaactctgagactttgtgatgtctagggtggcaggggagagagatgcttgctgctgcgcgtgcagggaacttacgtggacctgtgggatcggcctcagtgtggaccaactgctcagcacagatgctggtgtggagtagagggaactcagcggccgaaggcaagatggacaagacagaggggacgtggggcccgttttgttgggggcagcctgggatccctccatttcttgacatgtcctagcctctcactgtccccgttgagtcagctctctagatctcatggcggtcatagccagagaaacgggatgtcattttctttccctacctacaagtgtgtctggtgcttctcttcacagtttcttggtgctaagtgtatccttcttggtacagacagagtcttacagacagaccgggaaggccaggggatgagacgtttctattttgctctttggatagactctcgttgcttttttaaaaaagggccaggtgacaagattgccactggaaagtctctctctggggggaggggtggtgctcacagggcttaagagcagcccctcccccagggggcagggctacgaaggggaggggcgggccttatacaggagctgctttggaggtggcagtccctcctctccctgcagcagcactctgggagactgctgtggactcctccaatttcctaaggggattcagggcttaggtttttgtagattcaagagccaagaaatagctgcgttctgacggagcgtgatttctaagcaggggatgtggggggaggggggcggaccgtttaaatgaaatgtccgatttcccctgctccccaaacacacggaataagctactgttttcagaagtttctagaagggctaatataaatataaatatatatacacaaatataacgaagctgagcgctagactgacatttggctgcagtggctcacggcttcaggactggtggctttttttttttttttttaaaggaacaggtattactcctctgcatggatactgtatcacacccccccccccccaggtctttgtagccgagatggtgagggatgcttgcttgggctcagtgagacagttactcttgtttttattttatctttttttttcctttctaattttggagacaaggcctcaccctggagcccaggctgacctcagctcatgagcctccctgccctgtatctggcatttgggactctgactaccaggggagcgtcattttctcctggctggatttgcaggtgacttgcctagtacctgggggatcagggtttctgctagaaagcatcggttgttcaggtgcgcagggcttcaagggaaccggtccctggccaacattgctgagtgtgatcagtaaaatgcaccctttcccagtttgtagtcaacaggctcctctctccattttaaatccatgccttatatttctctgaataacccacttaaaaaaaaaaaaacaaaaaaacaaaaaaacacaaccgggaactcaatgctgaagcctcccccttttatctgccagaaccgaagtcagcaaagaaaactaaataaaaggagagagcctgtctggcaggggaagcagcaggcagcaggccatgccctcgcccagccagaattacacagaatgatctggaagacaccctctgcttgtgttgagtccctttcccagcaaggaaacaagtccttgcaagcatcacatttcaacatggtgggactctgtggtgtcagcctctttaaagacacacggtccagatcacagcggggggcgcgctgaccctggagagacccagcgcaaagggtgaggggtgagagaaaacctctctttctgtgttttgctttctgagcctggctttgcctgttagctagtgatagctccctggaggatttgaactccaaacacaggggttagcctctctggtcattttcatttcaatgaagctgtgttgccgagagagccgggcaccctgtgaccttcctaatggaacttctcagccaagtcctctgtaaatactctcccgtagtaatggaaaccacgtatttgtcgaatctgggccttggctcgcacgctgttcatttgagtgtgcttctcctgccccgggtttgatggggttgttttttaaatgcctgttttttctatgagatctgacttcttgatggacatttgtattagaatattgaagcatgctggctgtgtcactgttgtctcactgtctctgccgtggtgttacttggactgcatgagataatgggacagcctttctgttattggtgttattgaaaaaaaaaaaaacaaaaaaaacccaacccaacttccacagtgtgtgaagctctggcacaatctccctctctttatcctgctctccctggctgccaaggagcattgattttgattcgcttctatgtagagtctgtgaagagggagagaggctttgaaataaattttaaaaagacctcatactgggtttcagcagacagcagtgggtatgtgtgtgtgtgttcgtgcatgtgagtgtgtgtgcatccatccgactgggaggcctctgagatcattgctaaggagctggttgtgtgaggagctgaggcgccacccgggtctaaaagctgctggctgctctctgagggggagtcctgggagtctgtgggactgaagccttctagagtaggtccactcccttctggaagcttctctccctcacttcatcccccacaagcaagagctctgcccacatttggggttcaatttccctttgtctagatggagtttgagccagagttcttttggagagcccaggaaggactgtgcccactgtccacagtcctgggctgggaggccatgcccccccattccctgtccctctccacaccccatttacagttaccctggagactgcctccccacttctgtgatagccttgttctgtttcctttctaccttgatgggggatactgactgaagcctagtgtcacaggataacgaggccttgaatggcctgatgatactctttagatctgagctcatgtcctgtatgccacctgactgtactgtcatgtttctaaaattgacaaagtgtcattcttgctcactgagaactgggggagggggcagatccacgcatgagctccccaggtatctctgggagaccctgggtcactattggggacgacggcttgtttttgttattactattattgttttctgagacacggagccaggctggccttgaactctctatacagcagaggatagccctgaactcctcatcctcctgcctccacctcctgattactggaatgggccgattactggcttttgttgtggactttttggatgtccaccgtggactgttagaacacaagtctctcccgggttcatgctgttttcttttctgagcctgaagtcaacttggggagagcagggggtcagaaggtgctggggattcggggagaggggccgcagcctatttccacaggagctggtccgaagccccaccaagagggaaagcgtacatcacagtgtctcttgaaagctttagccaaaagtttatctttttgacattttaatgtattcactcgatgcttatttactgaacatctaccgtgtaccagctgaagacctccacgtctgagcaaagtgacttagttatggtacagcaacagtcctttttggagaccagatgccgtgaaatgtccctttccagtctggctcataatttagaacagatctgccgggtcaccattgtgaccccaagccttgctggcagattgctatatagtattttctgcatgccactctctgggctgaatgcaattaaaaattttgctacgttgtctccttctccactgagaggattggtcccttttgtacaataatcaacaccccccacacacacacacacaggagcacggccactgaacactgcaggaggcgcttcccaaggcttcccctgagagagccccatcctattggttagtaccactgatcccattttacaggcgaggaagctgagggcacccaaatggcaaactaagggttgcatttgagttcgtgccccccccccacaagccaatgtggtgcctgctctggtgtcacccatttgaaaagcaagcattatgggtgaaggcaagatattctaggtcaaaggcagacattgctagtctaagggcagggacaaacctgtggcccagcagggagtgtctactttagctgaaaagaaagcaagccttatttggggacacttgagagcagaaggttgtctccagttttagaaacctccagggtaaggggtatctaatgtgcaaacggactgtcccaaccattctggaggccctggggagtctcccacccctctctcctctatctcctctcccaaccctggatccccaaggtctttgcactggaagagtcaaggagccggtatggatggcagaggtggctgtgagggcatttggagactgggggagaggcagtaacttggggggacattctgtctgggtcctgacccttgttgccttgtgctcttttgtaaggggtggggggctccctgcctggatgctttgtacatatttgttacacttttattaaaaaattgatcgtgcacctct

SEQ ID NO: 4118 - DNA, 1612 bp, Rattus norvegicus
  Genbank Accession No. NM_057131
gccattttgctgtaagacgctgtgcggagctctgagctctttttccttcggacagccgaggcctggcgggccgggctggggtcgggaccaggaagaataacagagaggttaacagaatacaggataacaggagaataacaggaggttgtccataattgactttaagcagcaaacagtaaaacactgagctcttcagctccgcctttcttgctcttagaattggaacgccaagaaggttttgatgttttgtgtggcgcctcctgaattagaaaccaagatgaacataaccaaaggaggcctcgtgttgttttcagcaaattccaattcatcatgtatggagctttcaaagaaaattgcagagcggctgggggtggagatgggcaaagtgcaggtttaccaggaacctaacagagaaacacgagttcaaatccaggagtctgtgagagggaaagatgtatttatcattcagaccgtctcgaaggacgtgaacaccaccatcatggagctcctgattatggtatatgcatgtaagacctcttgtgccaagagcatcattggagtgatcccctactttccttatagcaagcagtgcaagatgagaaaaaggggctctattgtctcaaaattgctggcttctatgatgtgcaaagctggtctgactcatcttatcactatggatttacaccagaaggaaatccagggcttcttcaatattccagtggataatttaagagcctcccctttcctgttacagtatattcaagaagagatcccagattataggaatgcagtcatcgtggccaagtctccagcctcagccaagagggcacaatcttttgcagagcgtctacgcctggggatcgcagtgatccatggagaagcacaggatgctgagtctgacttggtggatggccggcactccccaccaatggtcaggagtgtagctgccatccaccccagcctggagatcccaatgctgattcctaaagaaaagcccccaatcacagttgttggtgatgttggaggaagaattgccatcatcgtggatgacattattgatgatgtggacagctttcttgctgcagcagagaccctaaaggaaagaggtgcatataagatctttgtgatggcaactcacggcttgttatcctctgatgctccccggctgattgaagagtctgccattgatgaggtggtggtcactaacacgatcccacatgaaatccagaagttgcagtgccccaagatcaagactgtggacatcagcatgatcctctcagaagccatccgccgaattcacaacggggagtccatgtcctaccttttcagaaacataggcttagatgactgaacagttctcctatggcagaactcccacaggtcaagtgggaggcccagcatatatgctggaaggcccatgcccagctagatacttgaccctcccttcctgacatcttcctgattgattcctgtgaaggtacaaggaccagctttcttaatgttggtttaggtttttgtgagtttgggggataatttttataacagaaagacctctttttaaataaaagaagttaaaacctaaaaaaaaaaaaaaaaaaaaaaaaataaaaaa

SEQ ID NO: 4119 - DNA, 1111 bp, Rattus norvegicus
  Genbank Accession No. NM_057133
agagccaggaagaaacaggaacaagacacagaccatgagctccagccaatcaggggtctgcccatgccagggctctgcaagccaccccaccattctctacacacttctaagccccggtcccaggaccaggcccatggcacccgcatctcgcagccactgcctgtgccagcaacaccggcctgtgcgcctgtgtgctccacaccgcacctgcagggaggccttggatgtcctaggcaagactgtagccttcctcaggaacctgccgtccttctgcctcctgccccatgaggatcagcgacggctgctagagggctgctggggccctctcttcctgcttgggttggcccaggatactgtgacctttgaggtggccgaggctccggtccccagcatacttaaaaagatcttgctagaggaacccaacagtggtgcccagggtgcccagccaccagacccaccacaaccctcactggctgccgtgcagtggctgcagcactgcctggagtctttctggagccttgagctgggtcccaaggagtacgcatacctgaaaggcactatcctcttcaacccagatgtgccaggcctccatgcctcctgccacattgcacacctgcaacaggaggctcactgggcattgtgtgaagtcctggagccctggtacccagctagccaaggccgcctggcccgaatcctcctcatggcttccaccctcaagaacatctcctgtacccttctggtagatctcttcttccgccctgtcatcggagatgttgacatcactgaactgcttgaagacatgcttttgttgaggtgacctgtagaatggggtccggtgcctccaaaggggagcctgaaaggccgcactcagctcccctggagcagccctcgtctcagccccacccccagcttggatttcctcggtttgcatacagtgtttgactaactgtccagcaggcccttgatggctcccaaaacctccaggccaatatgccttcccttacctgggtagggatgggagcatgaggctgtgcttcagggcagaattcctccagactttatatagaactaagttaagttattggtttttgtaataaaaggtgtgaactgc

SEQ ID NO: 4120 - DNA, 1071 bp, Rattus norvegicus
  Genbank Accession No. NM_057137
gcaagccagtgttaggaagtcgccccgtgatcgcgccgccttgggtttttctgttctttttttctctgtttatgtgcaaagctgccagcagcccatagaaacatgaccaccaatatgctccccttacacccgtactggcccaggcacctgagactggacaacttcgtgcctaatgacctcccgacttggcatatcctggttggcctattctccttctctggggtcctaattgtgatcacgtggctgttgtctagccgagtttctgttgtcccacttggaactgggcgtcgactggccctgtgctggtttgctgtgtgcacattcattcaccttgtgatcgagggctggttctctttctaccatgaaatccttctcgaagaccaagccttcttatcccaactctggaaagaatattccaagggagacagccgatatatccttagtgatggcttcatcgtctgtatggagagtgtcacagcttgtctctggggaccactcagcctatgggtggtgatcgcctttctccgtcatcaacccttccgctttgtcctacagcttgtggtgtctgtgggccagatatatggggatgtgctgtacttcctgaccgagctccgcgatggattccagcatggagagctaggtcaccccctttatttctggttttacttcgttatcatgaatgccatatggttggtgataccgggcatccttgtgtttgatgccatcaagcatctcacaaacgctcagagcatgctggacaacaaagtcatgaaaattaagagcaagcataactaaagagacggagagtgagctgagacctgtctgaggaggcgctctccccgcttaccagaagactcgaatcctcctcctcctcttcctccttctcctcgaacagttttggagggtcagagctatgggatttgccacactcaaagggccagagtcagaaaaggtagggaacatgcggagctactgccagggaccatagagaaagggtggaagagaagatgggaagtccctgtccaaaaccaggaaataaaacgtctttaactataaaaaaaaaaaaaaaaa

SEQ ID NO: 4121 - DNA, 3563 bp, Rattus norvegicus
  Genbank Accession No. NM_057139
tctagatccaacaatggaaaatctacatctacaatctcacttggaagagagtcaagaagccccttccttttgcgcacagaagaacaaattacaacaatcacacgatcagaacagaatccatcagtagatgctgccccagtgggacgacagaggaaagaaaagagactgacagacaccaggaaggaacaaggcagagctaggcccaaccaacagggagagcatgaaccctgggaaacagacattcggagtgaggatctcccaagaatcctgtctccgtgccttcattaaatcagggttcaccataggaatgctgtggccagctaggaacaaaagcatatcggcagagatgggaggaagtgggaggaagtgggaggctagagggacgtaaataaaaaaccaacagaaagaacaaaaacatacatttagggagaaactggaaggggaccgacggggacagtggcgaggtaggtgatggacggaggcacggtgtcctggtgtgggaggaattggcgccgttcgacaccaggcgggtccgttctgcagcagcactcagctatctccagcagcagccgccgcccgggccgaccagcagccgccgccacaggccgagggagccagcagtcagcggtgaacccgggccctcaccatgagttcttcgcctgttaatgtcaagaagctgaaggtgtcggagctgaaggaggagctcaagaagcggcgcctctcagacaagggcctcaaggccgatctcatggatcgactccaggccgcgctggacaacgaggcaggaggccgccccgccatggagcccgggaacggcagcctcgacctgggtggcgatgcggccgggcgctcgggagcaggcctagagcaggaggccgcggccggcgccgaagacgatgaggaggaggagggcatttccgctctggacggcgaccagatggagctgggcgaggagaacggggcggcgggggcggctgacgcgggcgcgatggaggaggaggaggcggcgtcggaagacgagaacggcgacgaccagggcttccaggagggggaggacgagctcggcgacgaagaggagggcgcgggcgacgagaacggccacggggagcagcagtcccaaccgccggcggcggcgcagcaggcttctcagcagcgcgggcctggcaaggaggccgcggggaaaagcagcggccccacctcgctcttcgcggtgacggtggcgccgccaggggcgaggcagggccaacagcaggcgggaggagacggcaaaacagaacagaaagctggagataaaaagagaggtgttaaaagaccccgggaagatcatggccgaggatattttgagtacattgaagaaaacaagtacagcagagccaagtctcctcagccacctgttgaagaagaagacgaacacttcgatgacacagtggtttgtcttgatacttataattgtgatctgcattttaaaatatcaagagaccgtctcagtgcttcttcccttactatggagagtttcgcttttctttgggctggaggaagagcttcttatggtgtgtcaaaaggcaaagtctgctttgagatgaaggtaacagagaagattccagtaagacatttatatacaaaagatattgatatacatgaagttcggattggctggtcactaaccacaagtggaatgttgcttggtgaagaagaattttcttatgggtattctctgaaaggaataaaaacctgcaactgtgagacagaagattatggagagaagtttgatgaaaatgatgtgattacgtgctttgctaactttgagactgatgaagttgaactctcttacgcaaagaatggacaagatcttggtgttgcctttaagattagtaaggaagttcttgctgaccggccattattcccccatgttctctgccataactgtgcagttgagtttaattttggtcaaaaggaaaagccatactttccaatacctgaagactgtacttttatccaaaatgtcccattagaggaccgagtcagaggaccaaaaggacctgaagagaagaaggattgtgaagttgtgatgatgattggcttgccaggagctggaaaaactacctgggttactaaacatgcagctgaaaaccctgggaaatataacattcttggaacaaacactattatggacaaaatgatggtggcaggctttaagaagcaaatggcagatactggaaaactgaacacactgttgcagagagccccacagtgtcttggcaagtttattgagattgctgcccgaaagaagcgaaattttattctggatcagacaaatgtgtctgctgctgcccagaggagaaaaatgtgcctgtttgcaggcttccaacgaaaagccgtggtcgtttgcccaaaagacgaagactataagcagaggacacagaagaaagcggaagtagaggggaaagacctaccagagcatgctgtcctcaagatgaaaggaaacttcacccttccagaggttgcagagtgttttgatgaaataacctatgttgaacttcagaaggaggaagcccagaagcttttggagcaatataaagaagaaagcaaaaaggcactgcccccagaaaaaaagcaaaacactggctcaaagaaaagcaataaaaataagagtggcaagaaccagttcaacagaggtggtggccatagaggacgtggaggattcaatatgcgtggtggcaatttcagagggggagctcctgggaatcgtggtggatataataggagaggcaacatgccccagagaggtggtggcggcggaagtggtggaattggctatccatacccgcgtggccctgtctttcctggccgaggtggttactcaaacagaggaaattacaacagaggtggaatgcccaacagagggaactataaccagaacttcagaggacgaggaaataatcgtggctacaaaaatcaatctcagggctacaaccagtggcagcagggtcaattctggggtcagaagccatggagtcagcattatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgatttttttttcttttcttttttgtacatttttaattgcagttttaaagtgaatcgtaagagaacctcagcattgtgcacgataagagaatgtgtcagtatttcagggttctacattttatctgtaaaatgtgactttttttttatcacaacaaaagtaaaatgttgctttgtacctggtgtcttttattaagcatttactctcccatttctcacagagaataacagtcgggagtcattgtcacaatgaaatagcaatgtcagcaaccagattcatggaaggactgagggtcctcatgaatggcattaagattctgtactgctcataatacactccatcctctctagatggccgggcaatagtggaggggtaatctctgac

SEQ ID NO: 4122 - DNA, 2563 bp, Rattus norvegicus
  Genbank Accession No. NM_057141
attggtggatccatttagttcaagaaaatggagaccgaacagccagaagaaaccttccctaacaccgaaaccaatggtgaatttggtaaacgccctgcagaagatatggaagaggaacaagcctttaaaagatctagaaatactgatgagatggttgaattgcgcattttgcttcagagcaagaatgctggggcagtgattggaaaaggaggcaagaatattaaggctctccgtacagactacaatgccagtgtttcagtcccagacagcagtggccccgagcgcatactgagtatcagtgctgatattgagacgattggagaaattctgaagaaaatcatccctactttggaagagggcctgcagttgccatcacccactgcaaccagccagctcccgctcgaatctgatgctgtggaatgcttaaattaccagcattataaagggagtgacttcgactgcgagctgagactgttgattcatcaaagtctggccggaggaattattggtgttaaaggtgctaaaatcaaagaacttcgagaaaacactcagacaacaatcaagcttttccaggaatgctgccctcattctactgacagagttgttcttattggaggaaagcccgatagggttgtagaatgcatcaagatcatccttgaccttatatctgagtctcccatcaaaggacgtgcacaaccttatgatcccaacttctatgatgaaacctatgattatggtggttttacaatgatgtttgatgaccgccgaggacgacctgtgggattccccatgcggggaagaggtggttttgacagaatgcctcctggtcggggtgggcgtcccatgcctccttctagaagagattatgatgatatgagccctcgtcgaggaccaccaccaccaccacctggtcgaggtggacggggtggcagcagagctcggaatcttcctcttcctccaccaccaccacccagagggggagatctcatggcttacgacagaagaggacggcctggagaccgctatgatggcatggttgggttcagtgctgatgaaacttgggactctgcaattgacacatggagcccatcagaatggcaaatggcttatgaaccacagggtggttctggatatgattattcttatgcagggggccgtggctcgtatggtgatcttggcggacctattatcactacacaagtaactattcccaaagatttggctggatctattattggcaaaggtggtcagcggattaaacaaattcgtcatgagtctggagcatctatcaaaattgatgaacctttagaaggatctgaagatcggatcattaccattacgggaacacaggaccagatacagaacgcacagtatttgctgcagaacagtgtgaagcagtattctggaaagtttttctaagactagtgaagaactgaaggagtcctgcatctttttttttttatctgcttctgtttaaaaagccaacattcctctgcttcctaggtgttctgcatttgaggtgtagtgaaatctttgctgttcaccagatgtaatgttttagttccttacaaacagggttggggggagggcatgcaaaaaaactaacattgaaattttgaaacagcagcagagtgagtgacttttattttttgttcattgttggtggttttaaaaattccccccgtgtaattattgtgaacaccttgctttgtggtcactgtaacattggggggtgggacagggaggaaagtaatagtccacatgtccctggcatttgttcagagcagtgtgcagaatgtaatgctcttttgtaagaaacgttttatgatttttaaaataaatttagtgaatctatttttggtggtctttttttttttttttaaagacaatttcaaatggtggttgaattttccagcccacccctaaactaaacactaagtttgattttcagcagctcctctgttggatataagtgcacctcttggatatagacaaacacattggcaaatttcagtttgggtgatttcttaatggttggaaagacttggcttgataaatttccatcacatattcatgcttataataagcttgggattttgtttgtttttgcaaatgtttgccactacttttcaacagttttctgttagtcgtggggaactgcggtggggagcaatactacaagagtaagcatctgagtatgtgccagaagcctggtgggcaatgagctttattaaccagagtaacacttggttatggaagtggctgatgctgaataaatcctggttatttttgttagataatttctcacctatagacttaagctgtcaactgctagcgtcttgttagttgaactttgtaaaaatatatatatacttgtttttccattgtatgcacaatgaaagaaaaaagatgtaccatttctctgttgtgtgttgaattatgtaggaaatgtttgtgaacgattcaaaaaaaatggaaaagttcctgtggatgttttgtgtagtaacttggcatctgtattgatagttccaaatccacatctaaataaaacttcatgatgtta

SEQ ID NO: 4123 - DNA, 1097 bp, Rattus norvegicus
  Genbank Accession No. NM_057143
gtgccgagcacagttactggaaggcttaaccaaagttttgatgcctgggaaccgcgcaggaaaaacacgcggaacgtgcttcacagtggcggctaactgctctcgttcgctgtgcagagccgtctggcagggttgacctcctaaagggatattccatctttattaatcattagtagtgtggtcagagacttagcaccattggtctcccccaacctggtccagacatttcagcagtttatcggaacagcaacaacagcaacaaaaccttcaaaatttacaagtctttaagaaatagaaatggcatccaaaagagctctggtcatcctagccaaaggagcagaggagatggagacagtgattcctgtggacatcatgcggcgagctgggattaaagtcaccgttgcaggcttggctgggaaggaccccgtgcagtgtagccgtgatgtagtgatttgtccggataccagtctggaagaagcaaaaacacagggaccatacgatgtggttgttcttccaggaggaaatctgggtgcacagaacttatctgagtcggctttggtgaaggagatcctcaaggagcaggagaacaggaagggcctcatagctgccatctgtgcgggtcctacggccctgctggctcacgaagtaggctttggatgcaaggttacatcgcacccattggctaaggacaaaatgatgaacggcagtcactacagctactcagagagccgtgtggagaaggacggcctcatcctcaccagccgtgggcctgggaccagcttcgagtttgcgctggccattgtggaggcactcagtggcaaggacatggctaaccaagtgaaggccccgcttgttctcaaagactagagagcccaagccctggaccctggacccccaggctgagcaggcattggaagcccactagtgtgtccacagcccagtgaacctggcattggaagcccactagtgtgtccacagcccagtgaacctcaggaactaacgtgtgaagtagcccgctgctcaggaatctcgccctggctctgtactattctgagccttgctagtagaataaacagttccccaagctcctgacggct

SEQ ID NO: 4124 - DNA, 2083 bp, Rattus norvegicus
  Genbank Accession No. NM_057146
ggttgcaaagaaatgcttctcaggactccagggctgcctaggaggagcggcatggcctcaggcgtgaccatcaccctagccattgcaatctttgccttggagatcaatgcacaggccccagagcccactccccgggaagagccatcagcagacgccctcctaccaatagactgcagaatgagcacatggagtcagtggtcacagtgtgatccttgcctcaaacaaaggtttcgctcaagaagcatggaagtctttggacagtttcagggaaaaagctgtgctgatgctttgggagacagacaacattgtgaacccactcaggagtgtgaagaggtacaggaaaactgtgggaatgactttcagtgtgaaacaggcaggtgcataaagaggaaacttctgtgtaatggtgacaacgactgtggagatttttctgatgagagtgactgtgaaagtgacccgcgcctcccgtgccgtgaccgggtggtagaagaatcggaactgggacgaacagcaggatatgggatcaacatcttagggatggatcccctgggcacgccttttgacaatgagttctacaatggactctgtgaccgggtacgggacggaaacactttgacatactatcgcaaaccttggaacgtagcatttctggcctatgaaaccaaggctgacaaaaatttcagaactgagaattatgaagaacagtttgaaatgttcaaaaccatcgtccgagacaggaccacgagttttaatgctaatttagctctaaaattcacaatcactgaagcacctataaaaaaagttggagttgatgaagtcagcccagaaaaaaactcttcaaagcctaaagactcttctgttgattttcaattttcatatttcaagaaagaaaattttcaacgattgtcatcctacttgtcacagacgaaaaagatgtttctgcacgtgagaggaatgattcaactggggagatttgtcatgaggaatcggggcgttatgctgacgacaactttcctggatgatgtaaaggctttaccagtttcctatgaaaagggcgaatattttgggtttttggagacttatgggactcactacagtagctctgggtccctgggagggctctacgaactgatctatgtcttggataaagcttccatgaaagagaaaggtgttgaactcagcgacgtaaagcggtgtcttgggtttaacctggatgtttctctatatacgcctctacaaactgccttagaaggaccatcattgacagccaatgttaatcacagtgattgcttaaagacaggggatggtaaagtagtaaacatcagccgcgatcacatcatagatgatgttatttcattcataagaggagggaccaggaagcaagcagttctcctgaaagagaagcttctcagaggagccaagacgattgatgtgaacgacttcatcaactgggcctcatccttggatgacgctccagctctcattagtcaaaaactgtcccctatctataatctcattcctttgacaatgaaagatgcatacgcaaagaaacagaatatggaaaaggctattgaagactatgttaatgaattcagtgctagaaagtgctacccatgtcaaaacggaggcacagcaattcttctggatggacagtgcatgtgctcctgcacaatcaagtttaaggggattgcctgcgaaatcagtaaacaaagatagccttcaggaaacaaagcaaaacctggttcacatggaaggtggaaaaaaggacaaaaaaagaagaagagagaggagagagaagagagagagaaaagaaaaaaccccaggactttccaacttagcatcctaccctagagcgaatcctcactgccaagtagaaagcagcttgcttcatggaaatcctaccaacctctgatgtcgtctctgtttcaggtctacagtgcctttctcccctctttaatgcctataatgcttccatttttttttttatccctaatgaagaatcggcagtgagatatgccaggactgccttttcccacaggcaatgccaatctctcgctaataaaacagagttaaattaaaaaca

SEQ ID NO: 4125 - DNA, 980 bp, Rattus norvegicus
  Genbank Accession No. NM_057147
ctcgttgagaagggagacgtagcctttgtgaagcaccagactgtcctggaaaacacgaacggaaagagcggacaggtcttctgtgggttgagatgtctatgattttatccgcctcagtcgtgcgtgtcagggatggattaccgctgtctgcatccactgattgtgaacagagtgcaggagtgcaggagtgcaggaagtactttaagatgctctcgaggaagcttgctcaatttcctgatagatgtacactgaaaactggacgccataatattaattttattagctctctcggcgtgagctacatgatgttgtgcactgaaaattatccaaatgttctcgccttctctttcctggatgagcttcagaaggagttcattactacttataacatgatgaagacaaatactgctgtcagaccatactgtttcattgaatttgataacttcattcagaggaccaagcagcgatataataatcccaggtctctttcaacaaaaataaatctgtctgacatgcagatggaaatcaagctgaggcccccttaccaaatcccaatgtgtgaactgggatcagccaatggagtcacgtctgcattttctgttgactgtaaaggtgctggtaagatttcttctgcccaccagcgactagaaccagcaactctgtcagggattgtggcatttatccttagtcttttatgtggagctctgaatttaattcgaggctttcatgccattgaaagcctcctgcagagtgatggtgaggactttagttacatgattgcatttttccttgggacagcggcctgcctttaccagatgatttgcctttgccttcaggggagaaaggagaggacataattaactgccactgtgatgaagaaaccagtcacaacacatgagaagctctgctttccttctctgcccatcttccccttttgttttacaaatcagcctggcatgcctgcgagtgtgagacctggt

SEQ ID NO: 4126 - DNA, 1109 bp, Rattus norvegicus
  Genbank Accession No. NM_057197
gaattccctgctgcaaacatggcgctgctggcccgtgcgttctttgctggggtgtcccgcctcccctgcgatcccggtcctcagaagtttttcagctttggaacgaaaaccctgtatcaaagcatcgatgctccacagtctaaattcttcccacccattttaaagcctatgctaccacctaatgcctttcaaggaaaagtggctttcatcacgggaggaggcactggccttggcaaggcaatgacaactttccgctccagcctgggtgcccagtgtgtgatcgcgagcaggaatattgatgttctgaaagctactgcagaagagattacttctaaaactggaaataaggtctatgcgattcggtgtgacgttcgagatcctgatatggtacacaacacagtactggagctgatcaaagttgcagggcatcctgatgtggtgataaacaatgcggcagggaacttcatttctcccagtgagagactgtctcccaatggttggaggaccataactgacatagttctcaatggtacagcctatgtgacgatagaaattggaaagcagctaattaaagcacagaaaggagtcgcctttcttgctatcactacgatctatgctgagagcggatcaggctttgtaatgccaagttcttcagccaaatcaggcgtggaagccatgaataagtctcttgcagctgaatggggtagatacggaatgcgtttcaacataattcagccagggcctatcaaaaccaaaggtgcctttagccgtttggacccgactggaaaatttgagaaagatatgatcgagagaatcccctgtggtcggctgggaactgtggaggaacttgccaatctagcgactttcctttgcagtgattatgcctcttggatcaatggggcagtcattcgatttgacggtggagaggaagtgtttctgtcaggtgaattcaactctctaaagaaggtcaccaaggaggagtgggatgtaatcgaaggcctcatcagaaagacaaaaggctcctaagacgttcatggcttcctctgtgacaaactaaagtttagggactatatagatggacatttgagttaataaattttttgtctgat

SEQ ID NO: 4127 - DNA, 1101 bp, Rattus norvegicus
  Genbank Accession No. NM_057208
agcagctgggtaggcaccatggccgggagcaccaccatcgaggcggtaaagcgcaagatccaggttctgcagcagcaggctgatgatgcggaggagagggctgagcgcctccagcgggaagtggagggagaaaggcgggcccgggagcaggctgaagctgaggtggcttccttgaaccgtaggatccagctggttgaagaggagctggaccgcgcccaggagcgccttgccactgctttgcagaagctggaggaagcggagaaggctgctgatgagagtgagagaggtatgaaggtgattgaaaaccgggctctaaaagatgaagaaaagatggagctccaggaaatccagctgaaggaagcaaagcacattgcagaagaggcagacaggaagtatgaagaggtggctcgtaagttggtgatcattgaaggagacttggaacgcacggaggaacgcgccgagctggcagagtctaagtgttctgagctggaggaggagctgaagaatgtcaccaacaacctcaaatctcttgaggctcaggcggagaagtactctcaaaaagaagacaagtatgaagaagaaataaagattcttactgataaactcaaggaggcggagacccgggctgagtttgctgaaagatcggtagccaagctggaaaagaccattgatgacttggaagatgagctctatgcccagaaactgaagtacaaggccattagcgacgagctggaccacgccctcaatgacatgacctctatataaactgacaccgtttctgctctgtcctggatctacccccctttcaggggtaattgatatgatataaggggcctaggaatacaattgatgttagggcgtttattagaataatgttggtgtactcggctatgaagaatagggcgaatggtcctgcggcgtattcgacgttaaagcctgagactaattctgattctccttctgttaagtcgaagggagctcgatttgtttctgctagggttgaaatgtatcatattatggctattggtcaggcggggattaatagtcagatatgttcttgtgcacttataagtatttctagggagaaggagccgcttatta

SEQ ID NO: 4128 - DNA, 2721 bp, Rattus norvegicus
  Genbank Accession No. NM_057211
gcggccgtcggcggacgcgggaagaagtgtcttgtaggcgcggcgccccactcagccccggcccccctcatccgcgtactcggctgatgcctcagggcgtcagctcggcggagaggcggtcgaggcgtgcgcctggctagcagttggctttccccgtgactcggacacgtttgcagtcgaataaacttgcgaccgccacgtgtggcatctctccaaggaaccggctcaggaggagggcgcgcccatcgtgggatcgcgcggggcgcccggcagggcggcggcgacagcggcagagccggccgcggctgctgcgtgcggaggcgctgccggttacgtaaagatgaggggctgaggtcgcctcggcgctcccgcgagtcgcaagctcccgcgcccccgccccctcggccgcgccgcaccgcgctcgtcgtccgagaccagggcagggctagccgaagctccgcagccaccctcaagtttggccgcaccgcccgggctgccgtcgcccgcaccatgtccgcggccgcctacatggacttcgtggctgcccagtgtctggtttccatctccaaccgcgccgctgtgccggagcacgggggcgctccggacgccgagcgactgcgactacctgagcgcgaggtgaccaaggaacacggtgacccgggggacacctggaaggattattgcacactggtcaccatcgccaagagcttgttggacctgaacaaataccgacccatccagaccccctcggtgtgcagcgacagtctggagagtcccgatgaggatataggatccgacagcgacgtgaccaccgaatctgggtcgagtccttcccacagcccggaggagagacaggattctggcagcgcgcccagcccgctctccctcctccactctggagtggcttcgaaggggaaacacgcctccgaaaagaggcacaagtgcccctacagtggctgtgggaaagtctatggaaaatcctcccatcttaaagcccattacagagtgcatacaggtgaacggcccttcccctgcacgtggccagactgccttaaaaagttctcgcgctcggacgagctgacccgccactaccggacccacactggcgagaagcagttccgctgtccgctgtgtgagaagagattcatgaggagtgaccacctcaccaagcatgcccggcgccacaccgacttccaccccagcatgatcaagagatcaaaaaaggctcttgccagccccttgtgaggtgctccccatatggcaaccaggcagagatggtcccggaaggacagagctcccaggaaacagacggacacatggaaatctgccaccgcagagttgtgctggccacaggaggtcactgctctttggtcaatattctgacactctccctgcgctgtttccaaaaagcacacggtagcctaagatcaaagtcaacatttggtccccttgcagaggccactctgaaccgtctctgactgttggagggcaggcaaataaatgcttttggtattttctcctttgttttggggggtggggggagggggcaaggccaagacttggggtaggatttttgaagattcaggctggtgtacatacgtctgactgggtgagttgacccctggcctcccacagtgactctggatccttgatgcttgctgactctcagaattgtttttcttctctctcaatgtcacgaccagagtgcttcagcttgtttagcagagccactctcgaatcacgttaacttttgagatttaaaaaacaaaacaaaacaacaaaaaaaaaaaaaaacccctccatagcacagctgtcttttatgcaagcaagagcacacctactccagcatgatctgtcatctaaggacttcaaaacaaaacaaaacaaaaaaaaaagttacttatagtcagtggataagcagagtccgaatttacactaaacaagacagaccttcgaggggtcataagtccggaactttcaaaccttgcttcgtatgaatcgtactatctgaacataaactgcacttttattttctaataccgagggtgaatacggtaaatccatgccttgagggtagaagccgacattctgtttggcacacgttattatctgcttattttccaggatacacatttccctgagaacccacggcagagatgtgagggcagaatgtatggaaacacatgctgaggaggggaaggaggaggggagtgctttaaagatacaaaaaaaaaaaaaaaaaaaaaaagagcaaacaattttaacttcatgaatttgtttgaattttcccaagcttcagataacaacgccactcacgggactaggacgctgcaagagcattgggctctgtgtagcattagctgataaatgggtgtatagccatcaccagacctggaaatgcccccttttggtgggggtgggggtgtttcttggtctctctttcgttcctatgaaatttccactaagaggtgcaagagttatatcaaaggaaagggaactgaaatatggaaaaaaaaaagtttgcccctgtaagtagtctctagggaaggaagatgccacaatggtttcagaggcgactctgcagaacagtcccttctgctgaacataggtcagagaaacactcgtgaatggcatcacatcgccaactgtctgcatcatggcccaccactacttagcttgtatctcggtgtctacacaatggcctgaaccactggtcaccat

SEQ ID NO: 4129 - DNA, 1614 bp, Rattus norvegicus
  Genbank Accession No. NM_057213
cgggccagcacaagatggcgttgcgagcgatgcggggaatcgtgaacggggccgcgcccgagctgcccgtgcccaccggtgggccgatggccggagctcgggagcaggcgctggcggtgagccggaactacctctcccagcctcgtctcacctacaagactgtctctggagtgaatggtccactagtgatcttagatcatgtaaagtttcccagatatgctgagattgtccacttgacattaccagatggcacaaaaagaagtgggcaagttctagaagttagtggctccaaagctgtggttcaggtatttgaaggaacatccggcatagatgccaagaaaacatcctgtgagtttactggagatattctccgcacaccagtgtctgaggatatgcttggtcgagtattcaatggatcaggaaaacccattgaccgaggtcctgtggtgttggccgaagacttccttgacatcatgggtcagccaatcaaccctcagtgtcgcatctacccagaagagatgattcagacgggcatttctgccatcgacggcatgaacagtattgcgaggggacagaaaatccccatcttttctgctgccgggttaccacacaacgagattgcagctcagatctgtcgccaggctggtttggtaaagaaatccaaagacgtggtagactacagtgaagaaaactttgccattgtgtttgctgctatgggagtaaacatggaaacagcccggttcttcaaatctgactttgaagaaaatggctcaatggacaatgtctgccttttcttgaatctggctaatgacccaactatcgagaggatcatcactcctcgcctggctctgaccaccgctgagtttctggcttaccagtgtgagaagcatgtcctggtcatcctgacagatatgagttcttacgctgaagcacttcgagaggtttcagctgccagggaagaggttcctggtcggcgaggcttccccggctacatgtatacggatttagccaccatctatgaacgcgctgggcgagtggaaggtagaaatggctctattacccaaatccctattctcaccatgcccaatgatgatatcactcatcctatccctgacttgactgggtatattactgagggccagatctatgtggacagacagctgcacaacagacagatttaccctcctattaatgtgctgccctcactctctcggttaatgaagtcagctattggagaaggaatgaccaggaaggatcatgctgatgtgtctaaccagttgtacgcatgctatgctatcggtaaggatgtgcaagccatgaaagctgtggtgggagaagaagccctgacctcagatgacctcctttacttggaatttctgcagaagtttgagaaaaacttcattactcagggtccctatgaaaatcgaactgtctatgagactttggacattggctggcagttgcttcgaatcttccccaaagaaatgctgaagaggatccctcagagtaccctgagcgaattttaccctcgagactctgcaaagcactagctgctgctgcttgtgcggctcgaccctcttgtgaagtgctggttctgtttcctgattccttttg

SEQ ID NO: 4130 - DNA, 432 bp, Rattus norvegicus
  Genbank Accession No. NM_078617
atgggtaagtgtcgtggtctccgtactgcccggaagctccgcagtcaccgacgggaccagaagtggcatgataagcagtacaagaaagcccacttgggcacagccctgaaggccaatccgtttgggggtgcctctcacgcaaagggaattgtgctggaaaaagtaggggttgaagccaaacagccaaattctgccatccggaagtgtgtcagggtgcagctcattaagaacggcaagaagatcacagcgttcgtgcccaatgacggttgcttgaacttcattgaggaaaatgatgaagttctggttgctggatttggtcgcaaaggccatgccgtgggtgatattcctggagtccgctttaaggtggttaaagtagccaatgtgtctcttttggctctgtacaaaggcaagaaggaaagaccaagatcataa

SEQ ID NO: 4131 - DNA, 1511 bp, Rattus norvegicus
  Genbank Accession No. NM_078622
tcggtgacgcggcgcgggaaggaatccgaggggaccggagcttagaggagttgagttaaaagaagatggatgcacagagttcagctaaagtcaattcaaggaagaggaggaaagaggtacctggccctaatggagcaacagaggaagatggaattccttccaaagtgcagcgctgtgcagtcggtttacggcagccagctcctttttctgatgaaattgaagttgactttagtaagccctatgtcagggtgactatggaagaagcctgcaggggaactccttgtgagcggcctgtgagagtttatgcggatggaatatttgacttatttcactctggtcacgcccgggctctgatgcaagcaaagaaccttttccctaatacatatctcatcgtgggagtctgcagtgatgacgtaacgcacaacttcaagggcttcactgtgatgaacgaaaatgaacgttacgacgcggtgcagcactgccgctacgtagacgaggtggtgaggaacgccccctggactctgacgcccgagttcctggcggagcaccggattgatttcgtcgcccatgacgatatcccctactcttcggcagggagcgacgatgtgtataagcacatcaaggaagcaggcatgtttgctcccacacagaggacagaaggcatctccacatcagacatcatcacccgcattgtccgtgactatgatgtgtatgcaagacggaacctgcagagaggctacactgccaaggagctcaatgtcagctttatcaacgaaaagaaataccacttgcaagaacgagttgataaggtaaagaagaaagtgaaagatgtggaggaaaagtcaaaagaatttgtgcagaaagtggaggagaagagcatcgacctcatccagaagtgggaggagaagtcccgagagttcattggaagtttcctggaaatgtttggtccagaaggagcgctgaagcacatgctgaaagagggaaaaggtcggatgctgcaggccatcagtcccaagcagagtcccagcagcagccctactcatgagcgctccccctccccctcctttcggtggcccttctctggcaagacttccccatcttcctccccagcaagtctctctaggtgcaaggctgtgacctgtgacatcagcgaggatgaagaggactaacttttcatcccggttccctctctctccccctgcccgtcacctccagaagctctgtcgaattccattttgtgatcccaacactaaacctaaggacacctacaaagaacagacaaacggggcagagacctgggaacgggggaaccaaaacagcccatgccctgcctgagacattctcagccacaccacggaggctgcccacaccttagaagcctgctctgcatccatcttcaccccagaacgttgctttactgtttattgctcatgtaatcttgacagggacattgtcatttacatcatttcttttaaaaagtagtctttcaaatataaaaaaaaaaaaaaaaa

SEQ ID NO: 4132 - DNA, 660 bp, Rattus norvegicus
  Genbank Accession No. NM_080580
atggcatccgctagtgagccccctgccagcccacgggacgctgccgaccagaactttgactacatgttcaaactgcttttgatcggaaacagcagcgtaggcaagacctccttcctgttccgctatgccgatgactccttcacccccgccttcgtgagcacagtgggcattgacttcaaggtcaagacagtctacagacatgacaagaggatcaagctgcagatctgggacacagcaggccaggagcgctaccggacaatcaccacggcctactaccgtggagccatgggcttcctgctgatgtatgacatcgccaaccaggagtccttcacagctgtgcaggactgggctacgcagattaaaacctattcctgggacaacgcccaggtcatccttgtggggaacaagtgtgacctggaggatgaacgggtcgtatctgctgaggatggccagaggctcgctggtgatcttggttttgagttcttcgaggccagcgccaaggagaacatcaacgtgaagcaggtgttcgagcgcctggtggatatcatctgtgacaagatgaatgagtccctggaacccagctccagcccaggcagcaatgggaaaggcccagccctcggggataccccaccccctcagccgagcagctgcggctgttag

SEQ ID NO: 4133 - DNA, 5413 bp, Rattus norvegicus
  Genbank Accession No. NM_080583
aaattggttttgcgcagtgtcttagatctagagagaatcgagacgggcaggaaaccattacaccaccttcccggctgtgctctctgactccgccgccaccccgcccttgcctccggttcacgctgaagatccgagaatcatgactgactccaagtacttcacaaccaataagaagggagaaatctttgaattaaaagctgaactcaacaatgaaaagaaagaaaagaggaaggaggctgtgaagaaagtgattgctgctatgaccgtggggaaggatgtgagctctctcttcccagatgtggtgaactgtatgcagactgacaacctggaactaaagaagcttgtgtacctctatctgatgaactatgccaagagtcagccagacatggccatcatggctgtcaacagctttgtgaaggattgtgaagaccccaatcctttgattcgagccttggcagttagaaccatgggatgcatccgggtggacaagattacagagtatctctgtgaacccctccgcaagtgcttgaaggatgaagacccctatgttcggaaaacagcagcagtatgcgtggcaaaactccatgatatcaatgcccagatggtggaagatcagggatttctggattctctgcgggatctcatagcagattcaaacccaatggtggtggctaatgctgtagcagcattgtctgagatcagtgagtctcacccaaacagcaacttacttgatctgaaccctcagaatatcaataagctgctcacagccctgaatgagtgcactgagtggggccagattttcatcttggactgcctgtctaattacaaccctaaagatgaccgggaagctcagagcatctgtgagcgagtgacgcctcggctctctcatgccaattctgcagtggtgctttcagcagtaaaagttctgatgaagtttctagagttgttacccaaggactctgactactacaatatgctgctaaagaagctagcgcctccacttgtcactttgctctctggggagccagaagtgcagtatgttgccctgaggaacatcaacctaattgtccagaaaaggcctgaaatcttgaagcaggaaatcaaggtcttctttgtgaagtacaatgatcctatctatgttaaactagagaagttagacatcatgattcgtcttgcatcccaagccaacattgctcaggttctggcagaactgaaggaatatgccactgaagttgatgtggactttgttcgcaaagctgtgagggccattggacggtgtgccatcaaagtggagcaatcagcagaacgctgtgtgagcacactgcttgatctaatccagaccaaagtaaattatgtggtccaagaggcaattgttgtcatcagggacatcttccgaaaataccccaacaagtatgagagcattatcgccacgctgtgtgagaacttggactccctggatgaacccgatgcccgagcggctatgatttggattgtaggagagtatgctgaaagaatcgataatgccgatgagttactagagagcttcctggaaggttttcatgatgaaagcacccaggtgcagctcacgttgcttaccgccatagtgaaactgtttctcaagaagccatcagaaacacaggagctggtccaacaggtcttgagcttggccacacaggattctgataatcctgaccttcgagatcggggttatatttattggcgccttctttcaactgaccctgtgacagccaaagaagtagtgttgtctgagaagccattgatctctgaggaaacagacctcattgaacctaccctcctggatgagctcatctgccacattggttctttggcctccgtgtaccataaacctccgaatgcttttgtggaagggagccatggcattcatcgcaaacacttgccaattcaccatgggagcactgatgcaggtgatagccctgttggcaccaccactgcaaccaacctggaacagcctcaggtcatcccctctcaaggtgaccttctgggggatcttttaaatcttgacctgggtcccccagtgaatgtcccgcaagtgtcctccatgcagatgggagcagtggatcttttaggaggaggactggatagcctgcttggcagtgaccttggcgggggcattggaggaagtccggcagtaggacagtccttcatcccgtcatcagtgcctgcaaccttcgctccttcacctactcctgctgtggtcagcagtggtctgaatgacctgtttgagctttccactgggataggcatggcacctggcggatatgtggctcctaaggcagtctggctacctgctgtaaaggctaaaggcttggagatttcggggacgtttactcaccgccaagggcacatctatatggaaatgaacttcaccaacaaagctctgcagcacatgacggattttgccatccagtttaacaagaatagcttcggtgtcatcccgagcactcccttggccatacatactccgctgatgccaaaccagagcattgatgtgtctctgcctctcaacaccttgggcccagtcatgaagatggagcctctgaataacttgcaggtggctgttaaaaacaatattgatgtcttctacttcagctgcctcatcccactcaatgtgctttttgtagaagatggcaaaatggaacgccaggtcttccttgcgacgtggaaggatattcccaatgaaaatgagctccaatttcagattaaggagtgtcatttaaacgctgacacagtttccagcaagttgcaaaacaacaatgtttacactatcgccaagaggaatgtggaggggcaggacatgctgtaccagtccctgaagctcactaatggcatttggattttggcagagctgcggatccagccaggaaaccccaattatacgctgtcgctgaagtgtagagcccctgaagtctctcagtacatctatcaggtctacgacagcattttgaaaaactaataaatgggtccagtcagcctgtaatcagtgcaagccacgaactcttaactgaaagacattgtattgttgtgtagagcctgaacccaaaccctgcggtacccaccccggtagtggccagtcattttgtgctgatattagcactcaccccattggtaggttagcttcccgtgacatctccttccactatcgcccccctctgccacctgccgctgctctctgtccttagttgtgagttcctctgtgctgtgccaatggctagccttttctacaccctcttttgagtgtagtttgatattttgtaatcgaaagctcatttcacaagcagaaaaaggcaacaagttaattagagcgaggaagagtgtcactgaaacatacactgcaccttattgttttatatttttgtacagatgagatagatattgaggtagaacgctgagtagaaagggtgactgaccctcctcagacacagtcttattggagacatatggccctggccccttctggggcaaggagaggcgaccccactcctggtcttttgcattttcaccttggccacgccttccagctctcttatgcccatgctctctcatttggcgaccacattgatgtttctgagtgcagggacactggacatgtgagcacagtgctgagagatggcagagctgtgctcgtgtctacagcgctagcccaggagtcaccctgaggaggctgggtagacatgagtaagaacacagcgccctcccctagcctccttccctgtttttcagggctagttcagatttaaagtcagtgtttgagagttaagacagactttagtgacttccccaaccctgtttttctacaaagaaaggtgataggggagaagggtgctgccaaggtggcctcttggctcttgagtagcagagctgagactggtcccgacctccatcagcttccctatgtggccgccctcattattctttccttaaagcctctgccggtcctgtgcctcctgtggctctttgacactccatactgagtttggagctccaccgattccctggcgtccggtggcagctggcgtctcagttacatgagtttgcatccaggtaacaagagtgaaagcggagctgacattcgccaggactgtcctggagccacagttcggaggctggccagtgagcagtgagtatagaagtgtgtagaggtgttgccaattctcactgtccctcacctcactgatctgccctccattggtactcaagctccaaagcacaggaagatcattccagaaggctgtgtagttcttgtcatctcacagaggactggggatgggaagtgcctctcgctaaggaattggtatgaggcatcgaagaaagcctcatactgtcaccctgcttgagatgtggcacttgttgcacagcctggcacctggtattcagggtccattcagagtcctatgctcaaggcagaagcatgccagggtccaaagacctcatgtaggactcagacctgacccactggatcccgaggagaaactggaaaaatcagggtagaaaccagcttcttttaaaagtgtgtctggagtgatcctatttcctcccaaagtctttaagaggattgctggctggcaaaaaagaaataacatccctctctcactctctcactctctcactcactcactcactcactcactcactcactcaccatgtggggagtaagaaatactgcagggttgtgtgggaggcaggtggtatattgggtggaaagcaagttgaccaagttcccttgtcggtgccgattcctggagtcagttggatgtgagtggtgtaagggattcccactacagacagtgttctcatctcaaagcaaattcccaaaagtacatgtgtcagggcaagcagaaaattttataccagaacatgtccaccccagaaactaaggcctctatcagcccctctaccagtgacagataccagctgtggttctctgctggcctgagcccatccatggtgtctagctccctcttgtttttaccccaagggagttaggaggaggcaaggagctctcctgaagagactctgttgccttcctgaagcttccccttcaggtcagtttcgagcttgactagattgggagaactggggtcagtttatccgtatctgctctccttggctgaagtgtgtcgctgttgaaagctgaagtacggagggcagggaagcaaacccaccagagctctatctggtcagattccccacgtgtttgttcccagcctggtccctattgtgaagcttgggactgggaccaggtcggagagtaaaagctgtcccaggaatgcgtagtttcctgttctgtcggggtctgttgttggggaggtggggattggggagcctttaccttgtgtattcaccaataaactcatttacacaaaaaaaaaaa

SEQ ID NO: 4134 - DNA, 1505 bp, Rattus norvegicus
  Genbank Accession No. NM_080585
  misc_feature (1)..(1505): n = a or c or g or t
gtagcttggctgtgtcgggcctgaaccgagcagctgcgcgacgtcatggacacctccgggaagcaggctgaggctatggcgctgctggctgaagcggagcgcaaggtgaagaactcgcagtccttcttctccggcctctttggaggttcatccaaaatagaggaagcatgcgagatctatgccagagctgcgaacatgttcaagatggccaagaactggagcgctgctgggaacgctttctgccaggctgcccaactgcacctacagctccagagcaagcacgatgcagccacctgctttgtggacgccggcaacgctttcaagaaagctgacccccaagaggccattaactgtctgatgagagcaattgagatctatacagacatgggcagattcacaatcgcagccaagcaccacatctccattgctgagatctatgagacagaactggtggatgtagagaaggccattgcccactacgagcaatctgcagactactacaaaggagaagagtccaacagctcagccaacaagtgtctgctgaaggtggctggctacgccgcacagctggagcagtaccagaaggctatcgacatctatgagcaggtggggaccagcgccatggacagtcccctcctcaagtacagcgccaaagactacttcttcaaggcggccctttgccacttctgcatcgacatgctgaacgccaagcttgctgttcagaagtatgaggagctgttccctgccttctcggattcccgggaatgcaagctgatgaaaaagctgctggaagcccatgaggaacagaatgtggacagctacacagagtcggtgaaggaatatgactccatctccagactggaccagtggcttaccaccatgcttctacgaatcaagaagaccattcagggtgatgaggaagacctgcgctaggcctccagccactgccttccacccatctgtctgtcacagaggtggagccaacacctccaccaggagtctgaaggagtgggtncaatgtaggcctcatcctccagggcaccaggcaagctctcctggatggctggtcaccctatgcccactgcgtccttcaccccgccatttatttaagctcccaaaggtgtcctcctgctctggaaaacccacctggacagattctccaatacagacttctctgtgtgcttcaggaacctggagtcagcatccagtcccatctcctgaccagcagtgtactaaggctatttccatatctcctaccttgtaccctagcagagataagaacacaggtagttcgtgagacttgctctccctggctgggggtagcctctgcccctggagctttcccttgttcctacaatgccaacctctcaggttagacccagccctggagctcacagggtgccttggccctgccctgccctgcacctgcttctctcgctgcatccaggtctgtctgtcgacntgaagctgcggctggcccaagaaagacaannacctgccacnng

SEQ ID NO: 4135 - DNA, 2960 bp, Rattus norvegicus
  Genbank Accession No. NM_080698
gaggccaaacagaaggacgtggtcactctgaacggttcaacccaagggacaacatgcagtgggcctccatcctgctgctgcgcgggctctgctcgctttcccagggccagtatgaagaagactctcactggtggctccaatacctccgaaaccagcagtccacctactacgacccctacgacacttacccctacgagacctccgacccttacccctatgaagtagaggagggcccagcctatgcctatggtgccccacctccaccagagccccgtgattgtccccaagaatgcgactgtccccccaacttccccacagccatgtactgtgacaaccgcaacctcaagtacctgccctttgtgccctcccgcatgaagtacgtctacttccagaacaaccagatcgctgccatccaggaaggtgtctttgacaatgccaccggcctcctctggattgctctgcatggcaaccagattaccagtgacaagataggcaggaaggtcttctccaagctgaggcacttggagaggctgtacctggaccacaacaacctgacccggatgcccggaccactgcctcggtccctgagagagctccacctggaccacaaccagatctctcgggtccccaacaacgctctggagggcctggagaacctcacagcattatatctccatcacaatgagatccaagaagtgggaagttccatgaggggcctccggtccctgatcctactagacctgagttataaccaccttcgaagggttcccgacggtctgccctcagccctggagcagctgtacctagaacacaacaacgtctacaccgtccctgacagctacttccggggctcacccaagctgctgtatgtccggctgtctcacaacagtctcactaacaatggccttgctaccaacaccttcaattccagcagccttctggagctagacttgtcctacaaccagctgcagaagatccctcccgtcaacaccaacctggagaatctttacctccaaggcaacaggatcaatgagttctccatcagcagtttctgcacggtggtggacgtcatgaacttctccaagctgcaggtgctacgcctggatgggaacgagatcaagcgcagcgctatgccggtggacgccccactctgcctgcgccttgccagcctcatcgagatctgaggggcttcgccttgggctcggggctccgccttggactccgggctccgccttgggatcggagatcggggctcagggctccgggctccgggctccgggcactggactccgggctccaggcatcgggtaccgggcaccggggtcccggcatatgccctgccacctgctacactcagcttgaaggtctggtttggcttttgctggatggtctgggacaagcacgtgacagaagtccacaggatcttattcagtctccttccgataggcaaagttaggtgggatcaggggccaggccagtttctgcaggggatgaaagtggtggtaaaagaaatggccgcagagtctagcccccaaatcttactatccctcaacccttccccatgacctagtctggcagaccatccccttgcttggataatagcatataaccagacaatctgacttcagctgtgctcactcaatggcttggccagttgcttctgcagtcgctctgggctcctactccttgctcctcaaaacatcaaaacgtacttcctgcccagccacttcctctaggcccagctcatcccctctgccctctttcattgaggcctcttctaaggtcttagacaatcaggagacacccacaccccaaggttggtggggagctgtccaacaacctgtggaggaagaccacacattattatctgaggttaaaaggatatctaaaaccatcacacacacacacacacacacacacacacacacacacacacacaacgtcacctgtttaaagtcagcgtattgaacagtataatggtgactgatagtcatgacttaattacaaggggataaccagccctataatggaggatccatcagaggagagaagggtcaaatgctcatttttaggatccacaataagatggggaagagtcacacctcagaatggcaggactgaaggggcagccccccttccagcttcacctgaccaacatgatctgtgccccttcttgggcttttagtatcaaaggggccagtgtggtttccaaaccatgagaaagagcctctgcccatccttggatccaggtatggaggtttgttacacagaggcagaggcagactgtgccagccgtggacccacccactaacccagacaagggtgtgatctccataactggtttgtccctaaagctagagtttaaggtaccagctcttctggagatggtcactggggtacaggaagccctagccaggcccaaggcttacctacactagacatagtttcctctgcttccacactgtgggaccacaccttatactgatggtgcctgtgacgtgtagcttgtctgagagcaaccctgtcttctcctttttaaaggtgatgttgcctaggtacagccatcgggttctctagactcactgggaaagagccacgggtagccagtggcaagaaccagttgtgagatgttagcctgaggtaggtcccttcccagatgccttagacccatgactctgtgtgcacttaggagcaagcttccctgaaaaggacagggtggggtggggtgcttagactgtgccatgggttccagatcctgaaatccacaaaagccaaaccagcttgtttgaaccagggagtgccacatgtggagcaaggctgccctgcccagagctcttgagaagcacctgcatgcagataccatctggcctctataaagggtcctcagcaagaagcaagcatgagtggtggccaacctgaccaataaagttattttataagtgcaaaaaaaaaaaaaaaaa

SEQ ID NO: 4136 - DNA, 3073 bp, Rattus norvegicus
  Genbank Accession No. NM_080781
cttcccgacccccacccccacggagccagatttacctggcacctttcgtccttttcatcttgttttgagttggttataaacaggaaccatgaccgcagctgagaacgtgtgctatacgttaattaacgtgccaatggactcagaacccccttctgaaatcagcttaaaaaatgacctggagaaaggcgatgtgaagtcaaagactgaagctttgaagaaagtgatcattatgattctgaatggggaaaagcttcctggactcctgatgacgatcattcgtttcgtgctgcctcttcaggatcacaccatcaaaaagttgcttctggtcttctgggaaattgttccgaaaacaactccagatgggaggctcttacatgaaatgattcttgtgtgtgatgcatacagaaaggatctccagcatcctaatgagtttattcgtggatctactcttcgtttcctttgcaaattgaaggaagcagaattgctggaacctctgatgcctgctatccgtgcttgtttggaacatcgtcacagctatgttaggagaaacgctgttttggccatctacaccatctacagaaattttgaaaatcttatacctgatgctcctgagctgatacatgattttctggtaaacgagaaggatgcaagctgcaaaagaaatgcatttatgatgctcattcatgcagatcaggatcgagctttggattatttaagtacatgtattgatcaagttcagacatttggagacattctacagttggttattgttgaactaatttataaggtctgtcatgctaatccatcagagagggcccgtttcattcgctgtatctataacttactgcagtcatctagtcctgctgtaaaatacgaagctgctgggacactggtgacactgtcaagtgctccaactgcaataaaggctgctgctcagtgttacattgatttaattattaaggaaagtgataacaatgtaaagctcattgtcctggaccgattggtagaactaaaagagcatcctgctcacgagcgagtcctccaagatctggtcatggacatcctacgagtactgagtacaccagacctagaagtgcgcaagaaaacgctgcagttagcactggatcttgtctcatctaggaatgttgaagagttggttattgtcttgaagaaggaagtaattaaaacaaataacgtgtctgagcatgaagacactgacaaataccgacagcttctcgtgcgaacactgcattcctgctctgtccgatttccagatatggctgcaaatgttattcctgtgctaatggaatttctcagtgacagtaatgaagcagcagctgctgatgtcttggagtttgtgcgtgaagccattcagcgctttgacaacctgagaatgctgattgttgagaagatgctggaagtcttccatgctattaagtctgtcaagatttatcgaggagcactgtggatcctgggcgagtactgcagtactaaggaagacattcagagtgtgatgactgaagtccgcaggtcccttggggagatcccaatcgtagaatcagaaataaagaaagaagctggcgagttaaaaccagaagaagaaataactgttgggcccgttcagaaattggttacagagatgggcacctatgctactcagagtgcactcagcagctctagacctaccaagaaagaagaggacagaccacccttgagaggattcctcctggatggagatttctttgttgctgcctcccttgccacaactctgaccaagattgcattacgctatgtagcattggttcaggagaagaaaaagcaaaactcttttgttgctgaggctatgttgcttatggcaaccatccttcatttgggaaaatcctctcttcctaagaagccaatcactgatgatgatgtagaccgaatttccctgtgcctcaaggtcttatctgaatgctcacctttaatgaatgacatttttaataaggagtgcagacagtctctttcccaaatgttgtctgccaaactcgaagaagagaaactatcccaaaagaaagaatctgaaaagaggaatgtaacagtacagcctgatgaccccatttccttcatgcaactaactgctaagaatgagatgaactgcaaggaggatcagttccagctgagtttgttggcagcgatgggtaacactcagaggaaagaggcagcagaccccctggcgtccaaactcaacaaggtcactcagttgacaggtttctctgatccagtgtatgcagaagcttatgttcatgtcaatcagtatgatattgtcctggatgttcttgttgtaaaccaaaccagtgatactttgcagaactgcacattagagttagctactctaggggatctgaaactcgtggaaaaaccatctcctttgactcttgctcctcatgactttgcgaatattaaagccaatgtcaaagtagcatcaacagaaaatggaataattttcggcaatatagtttatgatgtctctggagcagcaagtgacagaaactgtgtggtcctcagtgacatccacattgacatcatggactatatccagcctgcaacttgcactgatgctgagttccgtcagatgtgggccgaatttgaatgggaaaataaagtgacagttaacaccaacgtgactgacctgaatgattatttacagcacatcctcaagtccaccaacatgaagtgcctgactccagagaaggccctttctggctactgtggcttcatggcagccaacctatatgctcgctctatatttggagaggatgcacttgcaaatgtcagcattgagaagccagttcaccagggaccagatgctgctgttactggccatataagaattcgtgcaaaaagtcagggaatggccttgagccttggagataaaatcaacctgtctcaaaagaagactagtctctaagaatgaacaaacggtcctcgaaagtgtaaggttaaaatttaggtgtgggctgattggactccgacgtttttgtactctttcatgctttatgtttgtagaatttgagttcatgctgaattcatt

SEQ ID NO: 4137 - DNA, 495 bp, Rattus norvegicus
  Genbank Accession No. NM_080782
atgtccgatcctggtgatgtccgacctgttccgcacaggagcaaagtatgccgtcgtctgttcggtcccgtggacagtgagcagttgagccgcgattgcgatgcgctcatggcgagctgtctccaggaggcccgagaacggtggaactttgacttcgccactgagacgccactggagggcaactacgtctgggagcgtgttcggagcccagggctgcccaagatctacctgagccctgggtcccgccgccgtgatgacctgggaggggacaagaggcccagtacctcctcggccctgctgcaggggccagggccagctccggaggaccacgtggccttgtcgctgtcttgcactctggtgtctcacgcccctgagaggcctgaagactccccgggcgggaccgggacatctcagggccgaaaacggaggcagaccagcctaacagatttctatcactccaagcgccgattggtcttctgcaagagaaagccctga

SEQ ID NO: 4138 - DNA, 1373 bp, Rattus norvegicus
  Genbank Accession No. NM_080783
ctctgcaggcgccatggaggagaaggtgctcgtcacgggcggggctggctacatcggtagccacacagtgttggagctgctggaggcgggctactcgcctgtggtcatcgacaacttccacaattccattcgtggagaagactccatgcctgagagcctgcgccgggtccaggagctgacaggccgctctgtggagtttgaggagatggacatcttggaccaggcagccctacagcacctctttaagaagcacaattttaaggctgtcatccactttgctgggctcaaggctgtgggcgagtcagtgcagaagcctctggattactacagagttaacctaacagggaccatccagctcctggagatcatgagggccatgggggtgaagagtctggtcttcagcagctcagccaccgtgtatgggaaacccgtacctgcctctggacgaggcccaccccaccggggctgtaccaaaccctacggcaagtccaagttcttcattgaagagatgatccaggacctgtgccgggcagacacggcctggaacgctgtgctgcttcggtacttcatccccataggcgcccatcgctctgcgcgcatcggcgaagatcctcagggtatccccaacaacctcatgccctatgtctcccaggtggcaatcgggcgacgagaggccctgaatgtctttggtgatgactacgctacggaggatgggacaggtgtgagggattacattcatgtggtggatctggccaagggccatatagcagccttgaagaagctgaaggagcagtgtggttgccggatctacaacctgggcacgggcacaggctattcggtcctgcagatggtccaagccatggagaaggcctcagggaagaagatcccgtacaaggtggtggcacggcgggaaggcgatgtggcggcctgttatgccaaccccagcctggcccatgaggagctgggctggacagcagccttggggctggacaggatgtgtgaagatctgtggcgctggcagaagcagaacccttcaggccttggggcgcatggctgaggctctccttaccacggaccagaaaagagcagctacctgctttgcagccgccacaggaccctacaccctcatgcgctgaggccaccctacctcaaaggccagctgtctctcagccctcccggcaggagacctctggttctactgaccagaaaggagtctgggtccttccagcctattttccccagagtccagcagctcatgtgatccccagagccttgtggaggccagggggtctgggaccaaagcctccctcaggcactaacttatacagctaagattgagctttccaaagtatttaaaataaaaatgtcttctt

SEQ ID NO: 4139 - DNA, 1712 bp, Rattus norvegicus
  Genbank Accession No. NM_080886
ggccgctgcacctgcccggtcttgcgccgagaccgctgtcaatcgcggggcaccaggaataaaaggccccttgcagagatttgaaaatggccatgaacaaaagtgttggcctcttcagctccgcatccctggctgtggactacgtagattccctgctgcctgagaatcctctgcaggaaccctttaagaatgcttgggtctacatgttggacaactatacaaagttccagatcgcaacctggggctccctgatcgttcatgagacgatctatttcctgttctctttacctggctttctattccagtttatacctttcatgagaaagtacaagattcaaaaggataaaccagaaacctttgaaggccagtggaagtgtttgaaaggaattctgtttaatcatttttttatccagttgcctctgatttgtggaacatactattttacagagtttttcaatattccttatgattgggaaagaatgccaagatggtatttcactttggcaaggtgtttgggctgtgcagtcatcgaggatacctggcactatttcctgcacagactccttcaccacaagaggatttataaatacattcataaagtccatcacgagttccaggctccatttggaatcgaagcagaatatgcacatcccttggaaaccctaattcttgggactggatttttcattggaattgtgcttttgtgtgatcatgtaattcttctgtgggcatgggtgaccatgcgtttgctagaaaccatcgatgtgcacagtggttatgatatccctctcaacccgttgaactacatccctttttataccggggctcggcatcacgatttccaccacatgaacttcattgggaattacgcctccaccttcacgtggtgggacagaatctttgggacggatgtccagtaccatgcctacactgaaaagatgaagaagcttgggaaaaagtctgagtgagcacctgctctccgccctcctgactgcagctggcaactaacattgcttctggggagcagaactaagcacgtgactcggctgctggtgataggaacattaacaacctttaagtactctgcgggatgagaactcttctgctcgacacccaagatctgtaaatgtgggaacaaagaaatagatacataagtacagttttcaggaggaggttttaaaggccatattgccaacctcaccgaaaggtttcaggaacccgaggaagtgttaatgtacaactcaccacttcacgccacccgaggctgaagttgacgttgccttttaagcctttttacatacactggccatttcagaaaattctcaacaataatgtctgccttcgagtttaagtcatggtgttttttagaattgacttgaaatgaaaatatcacaaagtgaatatatcagctggtgatcgagtgactgaaacccccctggtctgcggttgaccagttcaggactattctttctgtgaaggattgtttgattgtagtatctttatcagcatcttgtaaattggctcatttcctacgtgatgtacatagaatactataacttaacgactttcaagttacttggggcatttttaaattgaggagccccacttctgatgtccacccccttgtctttgtgtgtcaggtggtctcggagctttgtgaattctctatctgcacctgtcagagctggtgaaataaatgtgatttttgtccg

SEQ ID NO: 4140 - DNA, 3219 bp, Rattus norvegicus
  Genbank Accession No. NM_080888
ccgaccatgtctcacttagtcgagccgccgccgcccctgcacaacaacaacaacaactgcgaggaaggggagcagtccctgccgccgcccgctggcctcaacagttcctgggtggagctacccatgaacagcagcaatggcaacggtaatggaaatgggaagaatgggggcctggagcacgttccttcctcgtcttccatccacaatggagacatggagaagatccttctggatgcgcagcatgagtcgggacagagcagctcaagaggcagttctcactgtgacagcccttcaccacaagaagacgggcaaataatgtttgatgttgagatgcacaccagcagggaccacagctctcagtcagaagaagaagttgtagatggagaaaaagaagttgaggctttgaagaaaagtgcagactgggtatcagactggtccagtagacccgaaaacatcccacccaaagagttccatttcagacaccctaagcgtgcagcctctctaagcatgaggaagagtggagccatgaagaaagggggcattttctctgcagagttcctgaaggtcttcatcccatctctcttcctctctcacgtgttggctttggggctgggcatctatatcggaaaacgactgagcacaccttctgccagcacctactgagggagacgaaaagcccctgggaatccgtgtggcctgtgaagtggtgtattgtagtttgaatttgagacctattgtaagcatgatccccacctacaaccctatttttacatgcccaattccaagtaactctcaaatccagtattttactcaaactctgttggggcattttactaaccttgttccctttttggcctgtaaaacactttagagattcctaacagagtttactgttgtttagaaatttgcaagggcttttttcagcaacgccaccagcagattataatcttgtcaacagtgcatcgtctcctcttagtaccactagtcacacctgcatcattcatgctagaagctgtgttctagccatgcaattacatctctttctaaatgaggtcaggtttgcaaataatactatgaaagctttgtttagtctttgttttgttttccaggacaaaaacaagcttccctgagcttgagtttataaaatgaaaacaaaccaaaaaaaggaaaaaaaaaaaaaaaaaaaaaaaaaaaaaaagaaggcaaaacacaagcaaaaaaaaaatcctgggcaataaaaattactttaaagcagctctggagcccctctttcctcatcctcctgccgccctgaatgggtaggagacagctgtgtgagggacagacaggagagaggagaggagagcatgctcgcaggtttaacatcagtatattgcaatgctgtcttttctatggtagagaatctttatttgtaaggagtgtctcaggcctagacatacatgaaacttacttttgagattttcatgcgtttggtattttcatgtgttaactgcatgtgaatttttcatgactttctttgtttttctagtttctttttttctaagaagagacttggaacgagtctgattcatggtgttaatagaggcttcttgttttaggaagctttgcttacactctggagcctttacactctgaagaataacttcagagttattccaagtacttgtgtaacttggaaaagtagacttgggttgtgggaacagttgataaagttctggaaagatgccattcactctctttgggtccttacttcctgttgttgcctacagtcttcccaaggtctccttagtctctcccaggcccctgtgactgtcttacgtaagtgtcttctcagttctgtcaaattcctgatgctctatagcactcagaaaattctttgaatggcagactttcttctgtctgtttctaaaatgtgaagctttaggaccaaattgctagtatcaggattgcagattatctcaagtagattttgttagatttcagagcacagcatcactctgagggaatctgtgtcttatatataaataattactgttaatgatgtacactttgctgaagttatagaaccattgtgaatttcaaggctagcaacctacacggtgcaccaggttgacttgaataaatttggcaaccaggtttgccagcatgcagaaactcactcttctctcacataaagggttataaaattggtgtgttatatggaaatggaaaggaaggtagataagacatttctgtcatttttcaagaacatggctgtttatctttaaggcagataatatatccaaaatagttttgtgagttattttctttctggcatttaatgtctacctgatttgagggcaacttctgcccttttcctttcttgctcttaaacctggtgatgcttgatctgccttctcacctattacttcaagtgtttataattgagtttcttaggaagaaagcaaatctggtggcctgttgttttgttgttgtttttcaaattgtcaggactgctgaggctaacctgcagcacagtttgcagcactgacgtgtgagcagagcagaatcactctttaatgctcttataggcggacatcacctctctaaattcagtagcagtttcatcggcagtgccattgaactgtgggaacatttatgattttgtctcaaccttaaaactaaatttagttttgccagtttttgaaagtatcaataaaatcatggaatatgtcccagagcaactgtccatcagtgagcatgtacgatgtcgatttgcggttccaacatacaggatgttcatgctcctacacagattcttgttgagtgaaaacagattgccctatcacaaagcaggattcaacagagttgaaatttaagataaggtttaaaaagctttattcctgtttacaatttgggatgaaaagcaggcttcgttctaagtttattgaaacctggctcagatgtttgtaggtcaagagaaaagcggcacagagacagcacagtgagtcactcaattgcagtaaagagtgaaatggagacagcccgtgagacgaatctcacagtgaagcgtttgttggacctcctggtattaatggagccagagtgacatgcatccttcgtctgtctcttcgtcagcactggcgtcattcctttcagtttaaagaacacatgtaacttgtagctataaacattttgtgccattaaagctctcacaaaacttaaaaaaaaaaaaaaaaa

SEQ ID NO: 4141 - DNA, 2196 bp, Rattus norvegicus
  Genbank Accession No. NM_080891
atggccaccgatgacagcatcattgtgcttgatgatgatgatgaagatgaagcagctgctcagccaggaccctccaacccagcctctaatcctgtttcaccaggaccagaagcctctggtccctctgagtcccatggggatggagggagcagtaactcaggtagcaggaagtgctacaagttggagaatgagaagctgtttgaagagttccttgaactgtgtaagatgcagacatcggaccaccctgaggtggttccgttcctccacaaactgcagcagcgtgctcagtccgcttttctggcctctgcagagttccgcaacatcctctccagggttctgtctcggtctcggaaccggccagcgaagctctacgtctacattaacgagctctgcactgtccttaaagctcattccatcaagaagaagttgaacttagctcccgcggcctcagcggaatcatcgggtgataaccctcccacagatcccccgtctgaccttacaaacaccgaaaccactgcctctgaggcctcaaggactcgaggctcccggaggcagatccagcgcttggagcagctgctggcactgtatgtcgcagagatacagcggctgcaggaaaaggagttggatctgtcagaactggatgatcccgactcctcctatttgcaggaggcccgcttgaagcggaaactgatccgcctctttgggcggctgtgcgatttgaaggactgctcttctctgactgggaaggtcatagagcagcgaattccttaccgaggcactcgatacccagaggtcaacaggcgcatcgagcggctcatcaacaagccggggcctgacacgtttccggactatggagatgtgctgagagcggtggagaaggcggcgacccggcacagtctgggccttcccagacagcagcttcagctcctggctcaggatgccttccgggatgtgggtgtgaggttacaggagcgccgccacctggatctcatctataactttggctgccacctcacagatgactataggccaggcgttgaccccgcactcaccgatcccacattggctcgccgccttcgggagaatcgaaccttggccatgagccggctggatgaagtcatctccaagtatgccatgatgcaagacaagagtgaggagggggagagacagaagagacgggcccggctcttagccacttcccaatcttcagacctccccaaagcctcctcggattccggtgagggtcctagtggagtggcatcccaggaggaccctactacccccaaggctgagaccgaggatgaggaagacgatgaggaaagtgatgatgaagaggaggaagaggaagaagaggaggaggaggccaccgaagatgaagatgaggatttagaacagttgcaggaggatcaggatgatgaagaggaggaggaaggagataatgaagacgataaaagtcccgcatccccttcgcccattttccgcaggaaggaattcagcaacccacagaagggctcaggtccccaggaggagcagcaggagagaggactgacggggacgccagcatccccgctggaagcatccccgggccttcccagcaccgatgctgaaagcagcggcgagcagctccaggagcggctcctggcaggagagagtcccgtgtcccagctttctgagctagacatggaagctctgcctgaggagaccatcccttcccctgaggaaaggggcatttcctcttccaggagaaagtcagacagttccctccccaccatcttggaaaatggggcagctatggttacctctacgtccttcaatgggcgtgtctcttctcacccttgtcgagatgccagtcccccaagcaagagatttcggaaggaaaagaagcaactgggacctgggccgctaggaaacagctatgtaaaaaagcagacgatggcacagcaggacagtgggtggaagataagtgtcctgtctactccgtcctcccccttggcctctgtgggtcctgttgctgattcctccacgagggtggactctcccagccatgagctggtaaccagctccctgtgcaacccttctccatccctgatactccagactccccagtctcagtctccccggccttgtatttataagacgagtgtggccacccagtgcgatcccgaggagatcatcgtgctctcagactctgattag

SEQ ID NO: 4142 - DNA, 1685 bp, Rattus norvegicus
  Genbank Accession No. NM_080892
tctctgctgaacctttgtccattcctagcaaatcctgcaggaccagagtgtcagccagcagcatggctacaaaatgcacaaagtgtggtccaggttatgcgacccctctggaggccatgaaaggaccccgagaggagattgtctacttgccctgcatttaccgaaacacaggcattgaagccccggattatttggccacagtggatgttgaccccaagtctccccattatagccaggtcatccataggctgcccatgccacacctgaaggacgagctgcaccactcagggtggaacacctgcagtagctgctttggggacagcaccaagtcacgcgacaagctgatactgcccagcatcatctcctcccgcatctatgtggtggatgtgggctctgagcctcgtgccccgaagttgcacaaggtcattgagcccaatgaaatccatgccaagtgcaacctgggcaatctgcacaccagccactgcctggccagcggagaggtgatgatcagctccttgggggatccccaggggaatggcaaagggggttttgtgctgctggatggggagaccttcgaggtgaaagggacgtgggagaagcctgggggtgaagctccaatgggctatgacttctggtaccagcctcgacacaacatcatggtcagcactgaatgggcagctcccaatgtcttcaaagatggcttcaaccctgctcatgtggaggctgggctgtatgggagccacatacatgtgtgggactggcagcgacatgagattatccagaccctgcaaatgaaagatgggctgatccccctggagatccgcttcctgcacgacccagatgccacccagggctttgtaggctgcgccctcagctccaacatccagcgcttctacaagaatgagggaggcacctggtcagtggagaaggtgatccaggtgccctccaagaaagtgaagggctggatgttgccagaaatgcctggtttgatcaccgacatcttgctgtccctggatgaccgcttcctctacttcagcaactggctgcacggggacattcggcagtatgacatctctaacccgaagaagcctcgcctcactgggcagatcttccttgggggcagcattgttaaaggaggctctgtacaagtgctggaggaccaagagctaacgtgtcagccggagcccctagtggtcaagggaaaacgagttcctggaggtcctcagatgatccagctcagcttagatgggaagcgtctttacgtcactacatcactgtacagcgcctgggacaagcagttttaccctaatctcattagggaaggctctgtgatgctgcaaattgatgtagatacagcaaatggagggctgaagttgaaccccaactttctggtggactttgggaaagagcctcttgggccagcactggctcatgagcttcgttacccagggggtgattgcagttctgacatctggatctgaaggctagccctaaaggccttcctccacagtcggggtcctccttctgaggagcctagcttcgctctgctctgggtcccaactctccaaggccatgatgagaccatcgagaactgcagagcagtatctcactactaccttgcttgttgtttgtgccattcttaagtgagctcctggaagcaccaagaaataaaatgctgaaccttt

SEQ ID NO: 4143 - DNA, 4645 bp, Rattus norvegicus
  Genbank Accession No. NM_080899
  misc_feature (1)..(4645): n = a or c or g or t
aacccagtgtaccgtgagggttcggagccgcgcactgaggcgagggcgcagttccgctagggcgttgtagaaattgtttcatcatgagaaatctgaagttgcatcagaccctggaatttagggacattcaggcaccagggaaacctcagtgtttctgtctgcgagctgaacaggggacagttctgattggctcagaacgtggactgacagaagtagatcctgtgaaaaaagaagtgaagactgaaatttctttggtggcagaaggttttcttccagaggatggaagtggctgcattgtgggtattcaggacttgctggatcaagaatctgtgtgtgtggccactgcctctggggacgtcatagtctgcaatgtcagcacacagcagctggaatgtgttgggaatgtggccagtggtatctctgtcatgagctggagtcctgatcaagaactgctgctgcttgccacagctcaacagaccctgattatgatgacaagagactatgaagtaatcacagagcagcagatccaccaggatgattttggagaaggcaagtttatcaccgttggatggggcagtaaggacacgcagttccacggctcagaaggcaggccaataacctttccggtgcaaatgcatgagtctgccttgtcctgggatgaccacagaccacaaattacctggcgtggggatgggcaattttttgctgtgagtgttgtttgctcacaaacaggggctcggaaaatccgagtatggaaccgagagtttgccttgcagtcaaccagtgagtctgtgccagggctggggccctccctggcttggaaaccctcaggcagtctgattgcatctactcaggataaacccaaccagcaagacgttgtgttttttgagaaaaatggacttcttcatgggtattttacacttcctttcttgaaagatgaagttaaggtaaatgacttgctgtggaatgcagattcctcggtgcttgctgtgtggctagaagacctcccgaaggaaggcagttccactctgaaaagctatgtccagctctggaccgtggggaactatcactggtatctcaagcaaagcctgcccttcagcaccacggggaagaaccagatcgtgtctctgctgtgggacccagtgacgccgggccgactgcatgttctctgtcagggctggcggtatctatgctgtgactggcactggaccactgatcggagctctggaaatagtgccgatgacctggcaaatgtggctgtcattgatggaaacaaggtgttggtaacagtcttccagcggactgtgaccccacctcccatgtgtacctaccggctgctgatcccacatccagtgaatcaagtcatgtcctctgctcaccttggaaatgaccttgctgtccttgacgccagtaaccagatttctgtctacaagtgtgatgataaaccagacatggattccacagtgaaactaggagctgtgggtggaactggatttaaagttcctcttagaacacctcatctggaaaaaagatacaggattcagtttgggaacaaggaagaggaggaggatgtaagcccactgcaatttcgatttctcacctggattgaaggtgacgctttcctggccataagccacagtcactccagcccacagtccatcattcaccatctgactatggccggttctgagggggatgaggaacaaggacagctgaatgtcagttcatctgtgacagtggatggagttgtcattggtttatgttgctgttctaagaccaagtcatcagcagtacagctggctgacggccaggtgctcaagtacctttgggagtcgccttcttcggctgtggagccctggaagaactctgaagggcgtcctgtccgatttgctcgtccatgcacccagatggaagcagccgccattggaggggaggaatgtgtccttggtctgaccgacaggtgtcgctttttcatcaacgacactgaggttgcatcaaatatcacgtcatttgcagtgtgtgatgactttctactggtgacaacccattcccacacctgccagtgtttctctctaagtggtgcctcacttaaaatgctgcaggcaggtctgtgtggcagtcaggtgcccagtggagagattctgaggaaggtggagaggggttcccggatcgtcacagtcgtcccccaggacacaaagcttatactccagatgccgagggggaacttggaggttgttcatcatcgggccttggtcttggctcagattcggaagtggctggacaaacttatgtttaaagaagcgtttgaatgcatgaggaaactgagaattaacctcaatctgattcatgatcataaccccaaggtgtttcttgaaaatgtggaaaccttcataaaacagattgattctgtaaatcatctaaacttgtttttcacagaactaaaggaagaagatgtcacaaagaccatgtaccctcccccggttaccaagagtgtccaggtgtccacaaatcctgatggaaagaaagttgacctcatctgtgacgctatgagagtggccatggagaccatcaatcctcgcaagttctgcctgtccatactcacatctcatgtgaagaagacgactccagaactggacattgtgctgcagaaggtacacgaacttcaaggaaaaattccctttgttcctgagagtgtgagtgcagaggaggctttgaaatacctgctgctcctggtagatgttaatgaattatttaatcattctcttgggacctatgactttgatttggtcctcatggtagctgagaagtcacaaaaggatcctaaggaatatcttccatttcttaatacacttaagaaaatggaaactaattaccaacggttcaccatagacaagtacttgaaacgatatgaaaaggcccttggacacctcagcaagtgtggacctgagtatttcacagaatgcttaaatttgataaaagataaaaacttgtataaagaagctctgaagttatatcggccagactcaccacagtaccaggcggtcagtgttgcttatggcgagcacctggtgcaggagctcctgtacgagccagcagggcttgtgtttgcccgctgtggggcccatgagaaggctctggaagcgtttttggcttgtggcagctggcagcaagccctttgtatggctgcccagcttcagatggccaaagacaaggtggctggccttgctagaactctggcaggaaagctggtcgagcagaggaaacacagtgaggcagcaacagtcctggaacagtacgccctggattatgaagaagccgtgctcttgctgctagaaggatctgcctgggaagaagctctgaggctggtatacaagtatgacagagtggatattatagaaaccagcgtaaagccttccattttagaagcccaaaaaaattacatggactttctggactctcagacagccacattcattcgccataaaaaccgcttgaaggtggttcgagagctcaagagccaacgaccacgggtgcatgtggatcacgaggtggcccatggccgagagacggacctcttctcggaaaccagcagtattaggagtggcagcgagatgagtggcagatactcccacagtaactccaggatatctgcgaggtcatctaaaaaccgccgcaaggcagaacggaagaagcatagcctcaaagaagggagccccctggagggcctggcacttctggaggcgctgagtgaggtggtacagagcattgagaagctgaaagatgaagtgcacgctattttaaaggtgctctttctctttgagttcgaagagcaagcaagggagttacagagggcctttgagagtactctgcagctgatggggacggcacttccagacatctggactctcaccggccaacagagttcatccacacctgtcctaggtcccagttccactgtgaatagtatcatggcttcttaccagcagcagaagacttgtgtccctgttctcgatgcttgggcttgtttgccaccgaagatcgaccagagaagccagtggaagctgagcctgctggaatgactgccctgttaagaaggcatcgctgggaagaccatttgtgcttctggttcttgctcctcagagacctgactgtggagaactgggatgtgggatagtccgcctttgaactgcctgcagtggcagtgagcagcaccaggccccagccagctccagtctctggcctttctttggtgtatacatcttaggtactatgtcagaacttttgtcttagccagcatattacattctttgtaaaagttgctgttcagccagtcacagtgcgacatgtctataaccccagcaaccgaggaggctgaggcagaaacactgatggaagttcaagaccagtgtaggctacagcaaggccttgtctcaaaacaacccagcctgatgttcttgtactagtactgtctgaaagcatggatcttangcagatcatgaactgggttcccagatccaggcctggtttctgttacaaccttggacgctcatcattgatttgatcctcagttcctgttgttcatagggaatgatgtttcatggcttctacctcaaaaaatgaagacaagtgaaaccacaaaaaaaaa

SEQ ID NO: 4144 - DNA, 355 bp, Rattus norvegicus
  Genbank Accession No. NM_080902
gaaaccggcaggactggaagggacgtctcctctccgaagactcttcaagaaatcacaatgtcaaccaacacagaccttcctctctcttcatacgatgaaggtcaggggtccaagtttattcggaaagctagggagacaccgtttgtccccattggaatggccggcttcgcagcgattgttgcatatgggctctacaagctgaagagcaggggaaacacgaagatgtctattcacttgatccacatgcgtgtggcagcccagggctttgttgtgggggccatgactcttggtatgggctattccatgtatcaagaattctgggccaagcgtaagccttagaagagctggtggcatg

SEQ ID NO: 4145 - DNA, 1754 bp, Rattus norvegicus
  Genbank Accession No. NM_080906
cccccgggggaggtgcgagagggctggaaaggacaggtccgggcagcgatcgggggttggcatcagttcgctcacccttcgagaggcagatcgctcttgtccgcaatcttcgctgaccgcgctagctgcggcttctgtgctccttcgccgaacctcatcaaccagcgtcctggcgtctgacctcgccatgcctagcctttgggatcgtttctcgtcctcctcttcctcttcgtcctcgtcccgaactccggccgctgatcggccgccgcgctccgcctgggggtctgcggccagagaagagggccttgaccgctgcgcgagcctggagagctcggactgcgagtccctggacagcagcaacagtggctttgggccggaggaagactcctcatacctggatggggtgtctctgcctgactttgagctgctcagtgaccccgaggatgagcacctgtgtgccaacctgatgcagctgctgcaggagagcctgtcccaggcgcgattgggctcgcggcgccctgcgcgcctgctgatgccgagccagctgttgagccaggtgggcaaggaactcctgcgcctggcgtacagcgagccgtgcggcctgcggggggcactgctggacgtctgtgtggagcaaggcaagagctgccatagtgtggctcagctggctctggaccccagtctagtgcccacctttcagttgaccctggtgctgcgtctggactctcgcctctggcccaagatccagggcctgttgagttctgccaactcttccttggtccctggttacagccagtccctgacgctgagcaccggcttcagagtcatcaaaaagaaactctacagctccgagcagctgctcattgaagagtgttgaacttcgtcctggaggggggccgcactgccccccaaagtggagacaaggaatttctgtggtggagacccgcaggcaaggactgaaggactgtcccctgtgttagaaaactgacaatagccaccggaggggcgcagggccaggtgggagaaggaagtgttgtccaggaagtctctaggttgtgtgcaggtggccccctgttggggcacatgcccctcagtactgtagcatgaaacaaaggcttcggagccacacaggcttctggctggatgtgtatgtagcatgtatcttattaatttttgtattactgacaagttacaacagcagttgtgggccagagtcagaagggcagctggtctgcactggcctctgcccgggctgtgtgctggggggaggcggggggaggtctccgacagtttgtcgacagatctcatggtctgaaaggaccgagcttgttcgtcgtttggtttgtatcttgttttgggggtggggtggggggatcggagcttcactactgacctgttcgaggcagctatcttacagactgcatgaatgtaagaataggaagggggtgggtgttaggatcatttgggatcttcaacacttgaaacaaaataacaccagggagctgcatcccagcccatcccggtgccggtgtactggaggagtgaactgtgaggggatggggctgaggggggtggggggctggaaccctctcccccagaggagcgccacctgggtcttccatctagaactgtttacatgaagatactcacggttcatgaatacacttgatgttcaagtactaagacctatgcaatatttttacttttctaataaacatgtttgttaaaacaaaaaaaaaaaaaaaaaaaaaaaa

SEQ ID NO: 4146 - DNA, 761 bp, Rattus norvegicus
  Genbank Accession No. NM_130400
cccttagtggtactccgctccaggctgcgatttcgcgccaaacttgacggcactctaagctggtggggtctgatcgccgctgcagacatggttcgtccgctgaactgcatcgtcgccgtgtcccaaaatatgggcattggcaagaacggagacttaccctggcctctgctcaggaatgagttcaagtacttccagagaatgaccacaacctcttcagtagaaggtaaacagaatctggtgattatgggtaggaaaacctggttctccattcctgagaagaatcgacctttaaaggacagaattaatatagttctcagtagagaactcaaggaaccaccacaaggagctcattttcttgccaaaagtctggatgatgccttaaaacttattgaacaaccagagctagcaagtaaagtggacatggtctgggtagtcggaggcagctctgtctaccaggaagccatgaatcagccaggccacctcagactctttgtgacaaggatcatgcaggagtttgaaagtgacacattcttcccagaaattgatttggagaaatataaacttctcccagaatacccaggcgtcctctctgagatccaggaggaaaaaggcatcaagtacaagtttgaagtctatgaaaagaaagactaacatgaagatgctcccaagtcctactgcttctcctaaaaggatgcattttataagaccacttctgctggcttgcaatctatgagtaattatttctttagggaggggtggct

SEQ ID NO: 4147 - DNA, 2655 bp, Rattus norvegicus
  Genbank Accession No. NM_130405
gccctttccacccccgccaaccgccgctcgggcctcagcgccgtcgcgtcgcttcctcgctcgctcgccacacatcattcctgatgcagcgccgggacgaccctgccgcgcgcctcacccggtcctcgggccgcagctgctccaaggacccgtcaggtgcccacccctcggtgcgtctgaccccgtctcggccgtcgccgcttcctcaccggtcccggggaggcggaggtgggcccagaggaggcgctcgggcctcgcccgctacgcagccgccgccgctgctgcctccctctaatccgggtcccgacgcgactgtggtgggttccgcgccgaccccgctactgcccccgtcagccacagccgcggccaagatggagccggagaataagtacctgcctgaactcatggctgagaaggactcgctcgacccgtccttcactcacgccatgcagctgctgtccgtagaaattgagaagattcagaagggagagtcaaaaaaagatgacgaggagaattatttggacttattttctcataagaacatgaagctgaaagagcgggtactgatccctgtcaagcagtatccaaagttcaattttgtggggaagattcttggaccacaaggaaatacaatcaaaagactccaggaagagactggtgcaaagatctctgtcttggggaagggttcgatgagagacaaagccaaggaggaagagttgcgcaagggtggagaccccaaatatgcccatttaaatatggatctgcatgtcttcattgaagtctttggacccccatgtgaagcttatgctcttatggcccatgctatggaagaagtcaagaaatttctagtaccagacatgatggatgatatctgccaggagcagtttctagaattgtcctacttgaatggagttcctgaaccctctcgtggtcgtggggtgtctgtgagaggacgaggagctgcccctcctcctccacctgttcccagaggacgtggtgttgggccacctagaggggctttggttcgtggaaccccagtaagaggctccatcaccagaggtgccactgtgactcgaggggtgccacccccacctactgtgaggggtgctccaacaccgagagctcggacagctggtattcagagaatacctttgcctccaacacctgcaccagaaacatacgaagattatggatatgatgattcatatgcagaacagagctacgaaggctatgaaggctattacagccagagtcaaggggagtcagagtattatgactatggacatggggagcttcaagattcttatgaagcctatggacaagatgactggaatgggaccaggccatcactgaaggctcctccagctaggccagtgaagggagcatacagagagcacccatatggacgttattaaaaacaaacaggaggggaaaatatcagttatgagcaaacttgttactgatttcttgtatcccaggattcctgttgctttacccacaacagacaagtaattgtctaagtgtttttctttgtggtccctttcttttccccaccttcctccattcttaactctgcattctggcttctgtatgtagtattttaaaatgagttaaaatagatttaggaatatcgaattaattttttaagtgtgtagatgctttttttctttgttgtttaaatataaacagtgtaccttttataataaaaaaaagttgagttaaaaaaaaccacaaacatgttagtttcaaaagtggcattgcttgcttaaaggttctgaagtaaaggcttgtcaacgttttcttagctttgatttgaggcaccccgtaaagtcatagttgcagaatcccaaactaggctacatttcaaaattcagggctgcttaagctgtaaaatcacaatgttaacggcagtaggtgccaccatgtaaaagtgagctcagatgtctctaaaaacatttcctttaaaagcacatggcggttgaatcttaaggttaaattttaatatgaaagatcctcatgaattaaatagttgatgcaatttttaacgttaattgacttaaaacaacaacaaaattaggtttgtaaaatgactttttcattctgtgggttttgaaatctagccccagacatacagtgttgagagatacttagtgggggggggggttgaataggttgctggggagggaagctggccgcctaaatggagtctgacagttctttttagccacagtcttttcaataatagtactaataatcaaattttcagtatttaaaatgtcaagagtattttgtccatctgagattctgcactccatgaaaaactcacttggacactggggccgaaagctgacgctgttcattaagttgaccattgtcagtttcgcactgttgcccggtagttaagtatgttcaacactagcatgacataaaaagggacactgcagctgaatgagaagagaatcaaagtccctttgtacataagttaaagtcctaatggatttgtaccgtcctcccattttgtttttggaagattaaatgctacatgtgtaagtctgcctaaataggtagcttaacctatgtcaaaatgtctgcagcaagtttgtcaataaagtttagtccttttttaatcaaaaaaaaaaaaaaaaaaaaaaaaaa

SEQ ID NO: 4148 - DNA, 2340 bp, Rattus norvegicus
  Genbank Accession No. NM_130406
cactgattgaggaaaacatactggtcctctgtctgtaccatcagaggcctgtgcatccgaagatcgtaggttaccgagtgcatgagcacctagtctcccgcgctgccccgcccgccggcccggccctcccgccggctcgcccgccagcccctcgccacccggcggcggccgcagcttcggccgcaggaggcgccgtctcgctcccaggtgcgcgcttcgttcccggagccgcggagctcggcggccgccatggcgtccaacatggaccgggagatgatccttgcggattttcaggcatgtactggtattgaaaacattgatgaagctattacactgcttgagcaaaataactgggacttggtggcagctatcaatggtgtaataccccaggaaaatggcattctacaaagtgactttggaggtgagaccatgccaggacccacatttgacccagcaagtccacctgctccagctccagctccctcttcttccgcgttccgacctgtaatgccatccaggcagatcgtagaaaggcagccgcgcatgctcgacttcagagttgaatacagggacaggaatgttgatgtggtacttgaagacagctgtactgttggagagattaaacagattctagaaaatgaacttcagatacctgtgcctaaaatgctgttgaaaggctggaagactggagatgtggaagacagtacggtcttaaaatcactacacttgccaaaaaacaacagtctttatgtccttacaccagacttaccaccaccttcatcatccagtcatgctggtgccctgcaggaatcattaaatcaaaacttcatgctgatcatcacccaccgagaggtccagcgggagtacaacctgaacttctcaggaagcagtaccgttcaagaggtaaagagaaatgtgtatgatctgacaagcatacctgttcgacatcagttatgggaaggctggccagcttctgccactgatgattcaatgtgtcttgctgaatcagggctctcttatccctgccatcgactcactgtgggacgaagaacttcacctgtacagacccgtgagcaatcagaagagcaaagcacggtagttcatatggttagtgatagtgatggagatgactttgaagatgcttcagaatttggagtggtagacggagaagtatttggcatggcatcatctaccatgagaaaatctccaatgatgccagaaaacgcagaaaatgaaggagatgccttattacaatttacagcagagttttcttcaagatatggtgactgccatcctgtattttttattggctcattagaagctgctttccaagaggccttctatgtgaaagccagagacagaaagcttcttgctatctacctccaccatgatgaaagtgtactaaccaacgtgttctgctcacaaatgctttgtgctgaatccattgtttcttatctgagtcaaaattttataacctgggcttgggatctgacaaaggacgccaacagagcaagatttctgacaatgtgcaatagacactttggcagcgttattgcacaaaccattcggactcaaaagacagatcagtttccacttttcctgattatcatgggaaagcgatcatctaatgaagtgctaaatgtgatacaaggtaatacaacagtggatgagttaatgatgagactcatggctgccatggagattttctcagctcaacaacaggaagacataaaggatgaggatgaacgtgaagccagagaaaatgtgaagagagagcaagatgaggcttatcgcctttcccttgaagccgacagggcaaagagagaagctcatgagagagagatggcagaacagtttcgtttggagcagattcgcaaagagcaagaagaggaacgcgaggccatcagactctccttagaacaagccctgcctccagagccagaggaggaaaatgcggagcctgttagcaagcttcggattcgaacccccagtggcgagttcctggaacgccgtttcctggccagcaataagctccagattgtctttgattttgtggcttccaagggatttccttgggatgagttcaagttactgagcacctttcctaggagagacgtaactcagctagaccccaataagtcattattggaggtaaacttgttccctcaagaaacccttttccttctagcaaaagagtaaacatgactgagaggtggaggcagccactcctgacaagccaacggcacgcgtcaagagacgggctcctcaccagcccacctagatgctcgtgtcactcagttcaatgtcacctctgcctcttgcaagattgctggaaaaaag

SEQ ID NO: 4149 - DNA, 2301 bp, Rattus norvegicus
  Genbank Accession No. NM_130407
gaattcggcacgagctgtcttgccttggtctgcacttctcccatggctcctgcagacattccagcctctcttcctctcggtctgtgcctgctgctggcctctggctttgggcatgcaggcaagctgctggtggtgcccatggatggcagccactggttcaccatgcagatggttgtggagaagctccttcccaaaggccatgaggtggtggtggttgttccagaggtcagttggcagctgggaaaaccactgaattttacggtgaaaacgtattcagtttctcacactcaggaggatttaaatcgggagttcaagttttttattgattctcagtggaaaactcaacaagagggcggagttcttcctctactgactagccctgcccagggtttcttcgaattactgttttcacactgtaggagtttgtttaaggacaagaagttagtggagtacttgaagcagagttcgtttgatgctgtgtttctggatccttttgatgtgtgtggcttaactgttgccaagtacttttctctcccgtcagtggtcttcagcagggggatattttgtcactatcttgaagaaggctcccagtgccccagtcctccttcatatgtccccagaggtatcttgaaactcacagataccatgactttcaaggaaagagtgtggaaccttctttcctacatgggggagcatgcattctgtcccagttttttcaaaactgctaccgacattgcctctgaagttctccagaccccggtgactatgacagacctcttcagcccagtgtccgtttggttgttacgcacagacttcacgttggaattacccagacctgtgatgcccaatgtgatccacattggagggatcaactgccaccaaaggaagccactttccaaggaatttgaagcctatgtcaacgcctccggagaacatggcatcgtggttttctctttgggatccatggtctcagagattccagagaagaaagcgatggaaattgctgaggctttgggcagaattcctcagacggtcctgtggcgctacaccggaactagaccatcgaaccttgcaaagaacactattcttgtcaaatggctaccccaaaacgatctgcttggtcatccaaaggctcgggcgttcatcacacactccggttcccatggtatttatgaaggaatatgcaatggggttccaatggtgatgatgccttggaaaacgcccttaaaactgtcatcaataacaagagttacaaggagaacatcatgcgcctctccagccttcacaaggaccgtcctatccttgtttggtcatcagatggacaacgccaagcgcatgcaaactcggggagctggggtgaccctgaatgtcctggaaatgactgccgatgatgagcctctggacctggctgtgttctgggtggagtacgtgatgaggcacaagggggcgccacacctgcgccccgccgcccacgacctcacctggtaccagtaccactccttggacgtgattggctttctcctggccatcgtgttcacggtggtcttcattgtctataaaagttgtgcctatggctgccggaaatgctttgggggaaagggtcgagtgaagaaatcacacaaatccaagacccactgagaagtggcaggaagtgaaggagaagtattagtcccttatccaatcagttgaaacttggaaacaagtgttaaatccatgttgcttttattagggaaataattcaccatacactatacacccagaacatttttttttctttttctttttttcggagctggggaccgaacccagaacattttttttttaaataaaaacaatctaattgctggccacacccatcagggaagatactggaatatgtgatctgtttctccagtatcttcagtctggacaatgactgccatctgttggtaacttacagaaagtttagtgttctgttctgccttcagtgacagcaccacagtttcccttactcctgtcagctaatggcttcctcccctggattctcagaccagtgtggccttcccagtgttagtcattcctcactgtgctcatgttttgtgggtggcacggcctttgagctttgggagaaaacaagatgaggctgtgacactggtggccctgtgtttgagataataattattgcttgtctctgaatttgatgaaaactgaagtacattctaaagaaagtatgtcttctattgtgttcccaaaccaagaacttgtcaataaattcatataaattgtattattacttttaaaaaaaaaaaaaaaaaactcgag

SEQ ID NO: 4150 - DNA, 4256 bp, Rattus norvegicus
  Genbank Accession No. NM_130409
ctgctcccagatagatccaagacatgagactgtcagcaagaattatttggcttatattatggactgtttgtgtagcagaagattgtaaaggtcctcctccaagagaaaattcagaaattctctcaggttcgtggtctgaacaactatattcagaaggcactcaggcaacctacaaatgccgccctggataccgaacacttggtactattgtaaaagtatgcaagaatggagaatgggtaccttctaacccatcaaggatatgtcggaaaaggccatgtgggcatcccggagacacaccctttgggtcctttaggctggcagttggatctgaatttgaatttggtgcaaaggttgtttatacatgtgatgaagggtaccaactcttaggtgaaattgattaccgtgaatgtgatgcagatgggtggaccaatgatattccaatatgtgaagttgtgaagtgcttgccagtgacagaactggagaatggaagaattgtgagtggtgcagccgaaccagaccaggaatattattttggacaggtggtacgctttgaatgcaactccggcttcaagattgaaggacagaaagaaatgcactgctcagaaaatggcctctggagcaatgaaaagccacagtgtgtggaaatttcttgcctgccaccacgagttgaaaatggagatggtatatatctgaaaccagtttacaaggagaatgaaagattccaatataaatgtaagcaaggttttgtgtacaaagaaagaggggatgctgtctgcacgggttctggatggaatcctcagccttcctgtgaagaaatgacatgtttgactccatatattccaaatggtatctacacacctcacaggattaaacacagaattgatgatgaaatcagatatgaatgtaaaaatggcttatatcctgcaacccgatcacctgtttcaaagtgtacaattactggctggatccctgctccaagatgtagcttgaaaccttgtgattttccacaattcaaacatggacgtctgtattatgaagaaagccggagaccctacttcccagtacctataggaaaggagtacagctattactgtgacaacgggtttacaacgccttcacagtcatactgggactaccttcgttgcacagtaaatgggtgggagcctgaagttccatgcctcaggcaatgtattttccattatgtggaatatggagaatctttatactggcaaagaagatatatagagggtcagtctgcaaaagtccagtgtcacagtggctatagtcttccaaatggtcaagatacaatattatgtacagaaaatggctggtcccctcctcccaaatgcgtccgtatcaagacttgttcagtatcagatatagaaattgaaaatgggtttttttctgaatctgattatacatatgctctaaatagaaaaacacggtatagatgtaaacagggatatgtaacaaataccggagaaatatcaggaataattacttgtcttcaagatggatggtcacctcgaccctcatgcattaagtcttgtgatatgcctgtatttgagaatgctatgactaagaataataacacatggtttaaactcaatgacaaattagactatgaatgtcacattggatatgaaaatgaatataaacataccaaaggctctataacatgtacttatgatggatggtctagtacaccctcctgttatgaaagagaatgcagcattcccctgttacaccaagacttagttgtttttcccagagaagtaaaatacaaagttggagattcgttgagtttctcttgccgttcaggacacagagttggagcagatttagtgcaatgctaccactttggatggtcccctaatttcccaacgtgtgaaggccaagtaaaatcatgtgaccaacctcttgaaatcccgaatggggaaataaagggaacaaaaaaagttgaatacagccatggtgacgtggtggaatatgattgcaaacctagatttctactgaagggacccaataaaatccagtgtgttgacgggaagtggacaaccttgccgatatgcgttgagtatgagagaacatgtggagaccttcctgaacttgagcatggctctgtcaagttatctgtccctccctaccatcatggagattcagtggagttcacttgtacagaaaccttcacaatgattggacatgcagtagttttctgcattagtggaaggtggaccgagcttcctcaatgtgttgcaacagatcaactggagaagtgtaaagccccgaagtcaactggcatagatgcaattcatccaaataagaatgaatttaatcataactttagtgtgagttacagatgtagacaaaagcaggagtatgaacattcaatctgcatcaatggaagatgggatcctgaaccaaactgtacaagaaatgagaaaagattctgccctcctcccccacagattccaaatgcccaagtgattgaaaccacagtgaaatacttggatggagagaaagtatctgttctttgccaagatggttacctaactcagggcccagaagaaatggtgtgtaaacatggaaggtggcagtcgttaccacgctgcacggaaaaaattccatgttcccagccccctaaaattgaacatggatctattaagtcgcccaggtcctcagaagagagagatttaattgagtccagcagttatgaacacggaactacattcagctatgtctgtgatgatggattcaggatatctgaagaaaatagggtaacctgcaacatgggaaaatggagctctctgcctcgttgtgttggaataccttgtggacccccaccttcaattcctcttggtattgtttctcatgaactagaaagttaccaatatggagaggaggttacatacaattgttctgaaggctttggaattgatggaccagcatttattaaatgtgtaggaggacagtggtctgaacctcccaaatgcataaaaactgattgtgacaacttgcccacatttgaaattgccaaaccgacagaaaagaaaaaaaaatcatacaggtcaggagaacaagtgacattcagatgtccacctccgtatcgaatggatggctctgacattgtcacatgtgttaatacgaagtggattggacagccggtatgcaaagataattcctgtgtgaatccaccacatgtgccaaatgctactatactaacaaggcacaagactaaatatccatctggtgacaaagtacgttatgactgtaataaaccttttgaattattttggggaagtggaagtgatgtgcccaaaacgggattttggacagaaccaccgaaatgcaaagattcaacagggaaatgtgggcctcctccacctattgacaatggagacatcacctccttgtcattaccagtatatgcaccattatcatcagttgaatatcaatgccagaactattatctacttaagggaaataagatagtaacatgtagaaatggaaagtggtctcagccaccaacctgcttacatgcatgtgtgataccagaagatattatggaaaaacataatatagttctcagatggagggaaaatgcaaagatttattcccaatcaggggagaatattgaattcatgtgtaaacctggatatagaaaattcagaggatcacctccgtttcgtacaaagtgcattgagggtcacatcaattatcccacttgtgtataaaatcgctatacaattattagtaaaccttatggatgaacctttgtttagaaatgcacatgtatattactaatacagtttgaatttacatttgaaatattgtttagctcatttcttctaataagtatataaactttttttatatggtggttaatcaagtaactttacagactgttgccacaaagcaagaacattacattcaaaactcctaatccaaaatatgatatgtccaaggacaaactatgtctaagcaagaaaataaatgttagttcttcaatgtctgtttttattcaggacttttcagattttcttggataccttttgttgtaggttctgattcacagtgagtggaagacacactgactctgacttcaaattagtattacttgccaatacataacaaccaaactatcataatatcacaaatgtatacagctaattactgtgtcctacctttgtatcaataaagaaatctaagaaaaaaaaaaaaaaaaaaaaaaaaaaaaaaaaaaaaaaaaaaaaaaa

SEQ ID NO: 4151 - DNA, 1086 bp, Rattus norvegicus
  Genbank Accession No. NM_130412
atggtctggctggtggcaatgacgtccaggcagaggtccctctgtggtctggctgctcatggcctctggttcttgggccttgtccttctgatggatgcaactgctagacctgccaaccactcattttctcgggaaagagcagccaacagggatgaaaatgagatcatacccccagaccacttgaatggggtgaagctggagatggatggacacctcaataaggacttccatcaggaggttttcctgggaaaggacatggatgggtttgatgaggactcagagccacggagaagcaggaggaagctaatggtcatcttttccaaggtagatgtgaacactgaccggaggatcagcgctaaggagatgcagcactggattatggagaaaacagcagagcacttccaggaggctgtcaaggagaacaaactacacttcagggctgtggaccccgatggtgatggccatgtgtcctgggatgaatataaagtgaagtttttggcaagcaaaggccacaatgaaagggagattgccgatgccatcaagaatcacgaggagctcaaagtggatgaggagacacaggaagtccttgggaacctcagagatcgctggtatcaggcagacaatcctcctgcagacctgctgctgactgaggacgagttcctgtcattccttcaccctgagcacagccggggcatgctcaagttcatggtcaaagagatcgttcgggacttggaccaggatggtgataagcagttgtctctgcctgagttcatctctctgcctgtgggtactgttgagaaccagcaaggccaagacattgacgacaactgggtgaaagacaggaagaaagagtttgaggaactgattgattctaaccatgatgggattgtgaccatggaggagttggagaactacatggaccccatgaatgaatacaatgccctcaatgaagcaaaacagatgattgccattgctgatgagaaccagaatcaccatctggagcctgaggagatcctcaagtacagtgagttcttcacgggcagcaagctgatggactatgcccgcaacgtgcatgaagagttctga

SEQ ID NO: 4152 - DNA, 1628 bp, Rattus norvegicus
  Genbank Accession No. NM_130413
cggcgtccagcgaccgctgcctggacagccagtgacttccttgttgtgggtctcggccaggtcgtgtcccgagtcgtagccccgcggtgcttactcggaccgcttttgcaagtctaggtccaagctactaccatgcccaaccccggcagtacctcctctcccggctcaatccctgaggaaattaggaacctgttggcagatgttgaaacatttgtggcagacacactgaaaggggaaaatttatccaagaaagccaaggaaaagagagactctctcattaagaagataaaagatgtaaagtctgtctatcctcaggaatttcaagacaaaggtgatgccgaggagggggatgaatatgatgatccttttgctgggcctccagacacgatttccttagcctcagaacgctatgacaaagatgacgatggcccctctgatggaaaccagtttcctcccattgcagcccaggacctttcttttgtcataaaggctggttacctggaaaaacgcagaaaagatcacagctttctggggtttgaatggcagaaacggtggtgtgctctcagcaaaacagtgttctattattacgggagtgataaagacaaacaacagaaaggggaatttgccatagagggctatgacgtcagaatgaacaacacccttaggaaggatgcaaagaaagattgctgtttcgaaatctgtgctcccgataaacgtatctatcagtttacagcagcctctcccaaagatgctgaggaatgggtccagcagctgaaattcatattacaagacatgggatctgacgttattcccgaggatgaagatgaaaaaggggacttatatgatgatgttgatcatcctgttccggtcagcagcccacaaaggagccaaccaatagatgatgaaatttatgaggaacttccagaggaggaagaggacaccgcttcagtgaagatggacgaacaagggaaggggagtcgggacagtgtacagcatccctcaggagataaaagcaccgattatgctaatttttaccagggcttgtgggactgcactggatctctttctgatgagttgtcctttaagcgtggtgatgtgatttacattcttagcaaggaatacaatagatatggctggtgggtaggagaaatgcagggagccattggcttggtgcctaaagcctacctaatggagatgtatgatatttgagagtctgggagaaataaatcaacatttctactgaagaaaacaaaacttaaatgtagctttccccttttgctggcacagaagtctgtccatctgcaagcgctttggaacacagactgcctggagccaccttcctttgggagaccttcctgcctcagctgtcgtcctgtgtcgtcattcactaaagctcctgacgtcagattaagcaagcagtgatgggttacattagagacaagccgcagagataaggcctgttgctgtttcgcagataatgatgagttttaatttacccactggtttgtatggggaattcattgtgattgtatctgaatcttagtcattgaagccaccactgaaggttgctgtttctcgtagtcactgggttatttttagagtgccacatataatttcctaaactttgt

SEQ ID NO: 4153 - DNA, 2277 bp, Rattus norvegicus
  Genbank Accession No. NM_130428
cgcaagcgcagtctatcgctgaggcttgcgggaaggcaaacatggccggggttggcgcagtttcgagacttcttcgcgggcggcgcttggctctagctggggcgactcgtggctttcacttctctgttggtgagagcaagaaggcatccgctaaagtttcagacgcgatttctacccagtaccccgtggtggaccatgagtttgatgctgtggttgtaggtgcaggcggggcaggcttgcgagctgcattcggcctttctgaggcaggctttaacacggcatgccttacaaagctctttcctacccgctcacatactgttgcagcacagggaggtatcaatgctgccctggggaacatggaagaggacaactggagatggcatttctatgacaccgtgaaaggctctgactggctgggggatcaggatgccatccattacatgacagagcaagctcctgcctccgtggttgagctagaaaattacggtatgccgtttagcaggactgaagatgggaggatttatcagcgtgcatttggtggacagagcctcaagttcgggaaaggcgggcaggcccatcggtgttgctgtgtcgctgatcggacgggccactcactcttacacaccttgtatggacgatctctgcggtatgacaccagttattttgtggagtatttcgcactggatcttctgatggaaaatggggagtgccgtggtgtcattgcactgtgcatagaagatgggtccatacaccgaataagagcaaagaacactattattgctactgggggctatgggcgaacctacttcagctgtacttctgcccacaccagcacaggggacggcacagccatggtcactcgggctggtttaccttgccaggacttagaatttgttcagttccaccccacaggtatctatggtgctggctgcctcatcacagaagggtgccgtggagagggaggcattctcatcaacagccaaggcgaaaggttcatggagagatatgcccctgttgccaaggacctagcatcaagagatgttgtgtctcgatccatgactctcgagatccgtgaaggaagaggctgtggccctgagaaggatcacgtctacctgcagttgcaccatctgccccctgagcagctggccacgcgtctgcctgggatctcagagacggccatgatcttcgccggcgtggatgtcaccaaggagcccattccagtccttcccactgtgcattacaacatgggcgggattcccactaactacaagggacaggtgctgaagcacgtgaacggccaggatcagattgtgcctggtctgtacgcctgtggggaggctgcctgcgcctcagtgcatggtgccaaccggcttggagcaaactctcttttggaccttgtcgtctttggccgagcctgtgccctgagcattgcagaatcttgcaggcctggagataaagttcctccgattaaggcaaatgctggagaagagtcggttatgaatcttgacaagttgagatttgctgatggaagtgtaagaacatcagagctgcgcctcagcatgcagaagtcgatgcagagccatgccgccgtgttccgtgtgggaagtgtgctgcaagaaggctgtgaaaaagtcagccagctctatggagacctacagcatctgaagacgtttgacaggggaatggtctggaacacagacctggtggagacgctggagctgcagaatctgatgctgtgcgcactgcagaccatatatggtgcggaagcacggaaggagtcacggggagctcatgccagggaagattacaaggtgcggattgatgagtatgattactccaagcccatcgagggccagcagaagaagccatttgcggaacactggaggaagcacaccctctcatatgtggacaccaagactgggaaggttactttggattacagacctgttattgacaagaccttgaatgaggctgactgtgctactgtacctcctgctatccgttcctactgaaaaacctgacagctacaggaccagcttatgtgattatacatcatagcttacctaggtttcctctcatactcgtcttgttaaaaatctgctctcatgaacaaggagtcacttcacagattatgatcaacagcttggcagtacttgatgtgagggactcgagttgcaccattgtctctcattcttgtgcagtgataaactggtataattcttaaatgatgtacaaacgaacaatcttttatttctaaataaaaccacatagtatttg

SEQ ID NO: 4154 - DNA, 1448 bp, Rattus norvegicus
  Genbank Accession No. NM_130430
gaattcgcggcgcgtcgacctcaagaggcagaggcacatagagaaaccctatcttgaaaaacgggggagggagaaacaggggcagaatgaaaaagggaggaaggaagaaaggaaggaatgagaaagaaaagtggaaataagtcacgtataaaacgagagttaaagcctacgtcatggggttggggatttagctcagtggtagagcgcttgcctagcaagcgcaaggccctgggttcggtccccagctccggaaaaaaaaaaaaaaaagaaaaaaaaaaaagcctacgtcatcctgtctccacttagctctgccgggtcatctgaaaaccacgtggtctatttagctggagtttccggtgacctcgccccaccttcaaactcagtacttgtgcattggctgaagtattttgtcccttgggaggacccgtagctccagcctcccggtgtccgtagccgggaaacctggcgtccggcgttttaggctgaggtccgcgatgtcgagtgaggaagtccggcaccgggcagagtcctctgaggcccgtgcggccgcggtcagcgacatccaggagctgatgcgacgcaaggaggaaatcgaggcgcagatcaaggctaattacgacgtcctcgagagccaaaaaggaattggcatgaacgagcctctagtggactgcgagggctacccccgggcagatgtggatttgtatcaggtccgaacagcaaggcacaacatcatctgtctccagaatgatcacaaggcactgatgaagcaggtggaggaggccctacaccagctacatgctcgggacaaagagaagcaggctcgggacatggctgaagcccgagaagaggccatgaaccgtaggctggcctcggacagtcccgccctacccaaggcctttgccagagtgaacagtatcagccctggttccccagccagtattgcgggcctgcaagtggatgatgaaattgtggagttcggctctgtgaacacccaaaacttccagtctctgcagaacgtgggcactgtggtgcagcacagcgaggggaagcccctgaatgtcatggtgatccgcagaggggagaagcaccagctcagactgactcccacccgctgggcaggaaaaggactgctgggctgcaatattacccctctccaaagatgactgcttcctgggagctgcaggagagcttcttcagctgggcccgcgcttggcctgggggatttcctcattctctcggctccctcaagtgtaaggatctggaagagagtggcggacgcctgagcgtcgaggtggaagagacgctttggctgcctgatgtagtctctgggttgaggcattattaaaaatgtggtttgtgcttaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4155 - DNA, 1619 bp, Rattus norvegicus
  Genbank Accession No. NM_130433
taaccttggccccggcggcgcgggggggggggggggcagggatggaaaagtaggggaaagggcaggggcgcggcctctcggggcgccgccacactattaaggctgggctagggctggtggccgagtgaagctgtgagagacccgtggaataactgagcttcgtcatggcgctgctacgaggtgtgtttatcgttgctgcgaagcgaacaccctttggagcttatgggggtcttctcaaggacttcactgccactgacttaactgaatttgctgccagggctgccctgtctgctggcaaagttccaccggaaaccatcgatagtgtcatcgtgggcaatgtcatgcagagctcttcagatgcggcgtacctggcaaggcatgtgggtttacgtgtgggagtcccgacggagactggggccctcaccctcaacagactctgtggctctggtttccagtccatcgtgagcggatgtcaggaaatctgctcgaaagacgctgaggtcgtcttatgtggaggaaccgagagcatgagccagtccccctactctgtcagaaatgtgcgcttcggaaccaaatttgggttagatctcaagctggaagatactttgtgggcaggattaacggatcaacacgtgaagctccccatggggatgactgcagagaacctggctgcaaaatacaacataagcagagaagactgcgacagatacgccctgcagtcccagcagaggtggaaagccgctaacgaggctggctactttaatgaggagatggcccccattgaggtgaagaccaagaagggcaaacagaccatgcaagtggatgagcacgcccggccccaaacgaccctggagcagctgcagaacctcccgccagtgttcaagaaagaggggacggtcacagcagggaacgcctcgggcatgtctgacggtgctggggtcgtcatcatagccagcgaagatgctgtcaaaaaacataacttcacaccactggccagagtcgtgggctactttgtgtctggatgtgaccctgctatcatggggatcggtccagtccctgccatcactggagcattgaagaaagctgggctgagccttaaggacatggatttgatagacgtgaatgaagcatttgctcctcagttcttggctgttcagaagagcttggatctcgaccccagtaaaaccaacgtgagtggaggtgccatagccctgggtcacccgctgggaggatctggatccagaatcaccgcacacctggttcacgagttaaggcgtcgaggtggaaaatacgcagtgggatcagcttgcattggaggtggccaaggcatctccctgatcatccagaacacagcctgaagggattgcaagcatcctacccaccctcacttggccaggctacggaacacaggcgacctttgagtcagccctgctgtgacagtaaatgcatttgaccaagccttgatgggttctgtctacttcatacctgcctagcgtgttagaataaaaagaccagccatcagaggcctttagagatacctactggtgtcattgtcagcagccaccactgtatgccttacatggtgaaattacaaactgaataaatgttgccttaactcc

SEQ ID NO: 4156 - DNA, 1089 bp, Rattus norvegicus
  Genbank Accession No. NM_130734
ggcacgaggggtcgcggtggcagccgtgcggtgcttggctccctaagctatccggtgccatccttgtcgctgcggcgactcgcaacatctgacgccatgaccgagcaaatgacccttcgtgggaccctcaagggccataatggatgggttacacagatcgccaccactccgcagttcccggacatgatcctgtcggcgtctcgagacaagaccatcatcatgtggaagctgaccagggatgagaccaactacggcataccacaacgtgctcttcgaggtcactcccactttgttagcgatgttgtcatctcctctgatggccagtttgccctctcaggctcctgggatggaaccctacgcctctgggatctcacaacgggcactaccacgagacgatttgtcggccacaccaaggatgtgctgagcgtggctttctcctctgacaaccggcagattgtctctgggtcccgagacaagaccattaagttatggaatactctgggtgtctgcaagtacactgtccaggatgagagtcattcagaatgggtgtcttgtgtccgcttctccccgaacagcagcaaccctatcatcgtctcctgcggatgggacaagctggtcaaggtgtggaatctggctaactgcaagctaaagaccaaccacattggccacactggctatctgaacacagtgactgtctctccagatggatccctctgtgcttctggaggcaaggatggccaggctatgctgtgggatctcaatgaaggcaagcacctttacacattagatggtggagacatcatcaatgccttgtgcttcagccccaaccgctactggctctgtgctgccactggccccagtatcaagatctgggacttggagggcaagatcatggtagatgaactgaagcaagaagttatcagcaccagcagcaaggcagagccaccccagtgtacctctttggcttggtctgctgatggccagactctgtttgctggctataccgacaacttggtgcgtgtatggcaggtgactattggtacccgctaaaagtttatgacagactcttagaaataaactggctttctg

SEQ ID NO: 4157 - DNA, 2700 bp, Rattus norvegicus
  Genbank Accession No. NM_130749
cggccgctgctcatcggccgcccagagctgggcggttttgttttcgccttggcgttgtgcagaatcaaagcgcaataagatgtccactaggacccctttgccaacggtgaatgaacgagacactgaaaaccacatttcacatggagatgggaggcaagaagtcacctcccgcaccgggcgctctggagctcggtgtagaaactcaatagcttcctgtgcagatgaacagcctcatattggaaactacagactattgaaaacaatcggcaaggggaactttgcaaaagtgaaattggcgagacacatcctcacaggcagagaggttgcaataaagataattgacaaaactcagttgaatccaacaagtctacagaagctcttcagagaagtaagaataatgaagattttaaatcacccaaacatagtgaaattgttcgaggtcattgaaacggaaaaaacactctacttaatcatggaatatgcaagtggaggtgaagtatttgactatttggttgcacatggaagaatgaaggaaaaagaagcaagagctaagtttagacagattgtgtccgcagtacagtattgccaccaaaaacggatcgttcacagagacctcaaggctgaaaatctgttattagatgcggatatgaacattaaaataacagattttggttttagcaatgaatttactgttggcagtaaactagacacgttttgtggtagtccaccatatgcagcccctgagctcttccagggcaagaagtatgacgggccggaagtggacgtgtggagtctcggcgtcattctgtacaccctagtcagtgggtcacttccctttgatggtcagaacctgaaggaactgagagagagagtactccgagggaagtacagaatccctttctacatgtccacagactgtgagaaccttctcaagcgcttcctggtgctgaacccagttaaacgcggcactctggagcaaatcatgaaggacaggtggatcaatgcaggtcatgaggaagaggagcttaagccatttgtcgaaccagaactagacatctcagaccagaagagaatagatattatggtgggaatgggatattcccaagaagaaatacaagaatctcttagtaaaatgaaatacgatgaaatcacagcgacgtacttgttactggggaggaagtctgcagagctggacgctagtgactccagttctagcagcaacctttcacttgctaaggtgcggccaagcagtgacctcagcaatagcactggccagtctcctcatcacaaagggcagaggagtgtgtcttcaagtcagaagcagagacggtacagtgaccacgctggaccagctattccttcagttgtggcatatccgaagaggagtcagaccagcactgcagatagtgacctcaaagaagatggagttccctcccgaaaatcaggcagcagtgctgtaggaggaaaggggattgcccctgccagtcccatgcttgggaatgcaagcaatcccaataaagctgatattcccgagcgcaagaaaagccctgctgtccccagtagtaatgcagcatctggtgggatgactcggaggaacacttacgtgtgcagtgagagatgtgcagcggacagacattcagtgattcagaacggcaaagaaagcagcctgacagaagtgttcgcttacgcagctagccctgcctcactctgtgccacatctacctgtcggctgagacatcagaggtcgatgtccgtgtcagcctctgggcaccccaagatggtgttacctccaatagacagtgaaggagataccttcaaggctatcaccactccagatcagaggactccagttgcttctacacacagtattagcagtgcgacaaccccagatcgcatccgcttcccaaggggcacagccagccgtagcactttccacgggcagcctcgagagcggcgaaccgcaacatataatggccccccagcctcacccagcttgtcccatgaagccacaccgctgtcccagacgcgaagcagaggctccactaatctttttagcaaacttacttctaaactcaccagaagacttccaactgaatatgagaggaacgggagatatgagggctcaagtcgcaatgtatcttcggaacaaaaggatgagaacagagaggccaaacctcggtccctgcgcttcacctggagcatgaaaaccactagttccatggatcccagtgacatgatgcgggagatccgcaaagtgctggacgccaatacctgcgactatgagcagagggagcgcttcctgctcttctgtgtccatggcgacgggcacgctgagagcctggtgcagtgggagatggaagtctgtaagctgccaagactgtctctgaatggggtccggtttaagcggatatcagggacatccatcgctttcaaaaacattgcttccaaaattgccaacgagctaaagctgtaacccagtaattatggtgtaaattaagtagcaagcaaaggtgtttccagagcactgatggaaatgtgtagagtaatatttaggcaataacgtgcatcttctaaatcatgacattaaagtctgaggacgagagcgggcctgggagcgaaggctggccttccctgcgaatgcactacattaaagtctgtgaccccgggcctttgttttgtttccattgccctgggggtcag

SEQ ID NO: 4158 - DNA, 1498 bp, Rattus norvegicus
  Genbank Accession No. NM_130755
cggccgctcctgttgcagctgcagctctctctctccgatcccttcccgccaggtcccggagttcgccctccatggctctactcactgcggcagcccggctcttgggagccaagaactcatcctgcctcgtccttgctgcccggcacgccagtgcttcttccacgaatttgaaagacatactgagcaatctgatacctaaggagcaggccagagttaagaccttcagacagcagcatgggaagacagtggttggccaaatcactgtggacatgatgtacggtggcatgagaggcatgaagggacttgtgtatgagacatcggttcttgatcctgatgagggcatccgcttccgaggctatagtatccctgagtgccagaaactgctacctaaggctaaaggtggggaagagcccctacctgagggcttattttggctgctggtaactggacagatgcccacagaggaacaggtctcttggctctcacaagaatgggcaaaaagggcagctctgccttcccatgtggtcaccatgctggacaattttccgaccaatctgcaccccatgtctcagctcagtgcagccatcacagccctcaacagtgaaagcaacttcgcccgggcatatgcagagggaataaaccgaactaagtactgggagctcatctatgaagactgtatggacctgattgccaagctgccgtgcgttgcagcaaagatctaccggaatctgtaccgggagggcagcagtattggggcaattgactctaagctggactggtcccacaattttaccaacatgttatgctacacagaacctcagttcacagaactcatgcgtttgtaccttaccatccacagtgaccatgacggtggcaatgtaagtgcccacacaagccacttggtgggcagcgccctttcagacacttacctgtcctttgcagcagctatgaatgggctggcagggcctctgcatggactagcaaaccaggaggtgcttgtctggctgacgcagctacagaaggaagtcggcaaagacgtgtcagatgagaagttacgagactacatctggaacacactcaactcgggacgggttgtcccaggatatggtcatgcagtcctaaggaagactgatccacgatattcctgtcagcgagagtttgctctgaaacatctgcccaaggatcccatgtttaagctggttgctcagctgtacaagattgtgcccaatatcctcttagagcaaggaaaggctaagaacccctggcccaacgtagatgctcacagtggggtgctgctccagtactatggcatgacggagatgaattactacacagtcctgttcggagtgtcgagggcactgggtgtgttggcccagcttatctggagcagagccctaggctttcctctagaaaggcccaagtccatgagcacggatggtctgatgaagtttgtggactctaagtcagggtaaaatgggagattatgggaaaactgact

SEQ ID NO: 4159 - DNA, 1292 bp, Rattus norvegicus
  Genbank Accession No. NM_130780
cgtagacttcttccctcctgcagcgaaggacagcatgagcacagctggaaaagtaatcaaatgcaaagcggccgtgctatgggagcctcacaagcccttcaccatcgaggacatagaagtcgcaccccccaaggcccatgaagttcgcattaagatggtggccaccggagtctgccgctcagatgatcacgcggttagtggatccctgttcacgcctcttcctgcagttctaggccacgagggagctggcattgttgagagcattggagaaggggtgacttgtgtgaaaccaggtgataaagtcatcccgctgttctctccccagtgtggaaaatgcaggatctgcaagcacccggaaagcaacctctgttgccaaactaagaatctgacacagcctaagggagctttgctcgacggcaccagcagattctcctgcaggggaaagcccattcaccactttctcagcaccagcaccttctcccagtacactgtggtagatgacatagcggtggccaaaatcgatgcggctgcaccactggacaaagtctgcctcatcggctgtggcttctcgactggctatggctctgccgtccaagtcgccaaggtgaccccaggctccacctgtgccgtgtttggcctgggaggtgttggtctgtctgtcgtcattggctgtaaaacagcaggagcagccaagatcattgccgtggacatcaacaaagacaagtttgcgaaggccaaagagttaggtgccactgactgtatcaaccctcaagactacaccaaacccatccaggaagttctccaggagatgactgatggaggggtggacttttcatttgaagtcattggccgtcttgacaccatgacttctgccctgttaagctgccattcagcatgcggtgtaagcgtcattgtcggggtgcctcccagtgcccaaagcctctccgttaaccccatgtcgctgctgctgggacgcacctggaaaggagcaatattcggcgggtttaagagtaaagatgccgtccccaaacttgtcgctgacttcatggctaagaagtttccgttggagccgctgattactcatgttttaccttttgaaaagataaatgaagcatttgacctgctccgtgctggaaagagtatccgtaccgtcctgacgttctgagaacacatgaatgccttcccggtttctgactcctccgcctaccgaatcaagcgccagccacatcacaaccttaaccttgctcttcagagacacacagccaataaagcacctgtgcaagctttccgtg

SEQ ID NO: 4160 - DNA, 1082 bp, Rattus norvegicus
  Genbank Accession No. NM_130823
gaattccggagaatcttctttcgtctgctcgctctctctcccgtcgtcctagcccgccgccgcctgctgagcttgccctctccccgcttgcagacatggctgacatcaagaacaaccccgaatattcttcgtttttcggtgtcatgggcgcctcgtccgccatggtcttcagcgccatgggagctgcctatggcacagccaagagtggcactggcatcgcagccatgtcggtcatgaggccagagctgatcatgaagtccatcatcccagtggttatggctgggatcatcgccatctacggcctggtggttgcagtacttatcgctaactccctgactgatggcatcaccctctacaggagttttcttcaactgggtgctggcctgagtgtggggctgagtggcctggctgctggctttgcaattggcattgtcggagatgctggtgtccggggcactgcccagcagcctcgactgttcgtgggcatgatcctgatcctcatctttgcggaggtgcttggcctctacggtctcatcgtggccctaatcctctccacaaagtagtcttttccaccaccagtcacaggataggatgtaaagatcacccctcctcattccagaaggaacagcctgacacatgcacgggcagctgcccctcagtagttggtcttgtaaatgtgcagtgtccctagtgccattgtctgttgccccgccttgcccctactgccccgtgctgtggacatctgggcccactcatctcccacccaggcccctgaccagtgacgatttcagcctctggtcaccccacccatcgccctagagtgcgccttgtgtataagaatgaattagagttgtcatttttctcttcactggatgtttatttataaaagatttgacctattcatgtgtctgtggagcagccctgtctcccaactctatagtaatcattagtagactgttgccttgtggggttcctgttgctgagactccttggatggagccaccctgcccccagccctgaacagccgggggggggtagagagttcctcagagctggctcccagctgtgtccaataaaagttc

SEQ ID NO: 4161 - DNA, 2775 bp, Rattus norvegicus
  Genbank Accession No. NM_130826
ctcttctgctcaagatggttgcgtcccgggcaattggcagtctcagtcgcttctctgccttcaggatcctgcgctccagaggctgcatttgcacagctttacaacttcttcctgctttgctgtctagaacccatattaattatggagtcaaaggggatgtggcagttattcggattaactcgcccaattcaaaggtaaatacattgaataaagaagtacaatcagagttcgtagaagtaatgaacgaaatctgggccaacgaccaaatcaggagcgccgtccttatttcgtcaaagcctggctgctttgttgcaggtgctgacatcaacatgctggcctcttgtacaacgccccaagaagcagcacgaatatcacaagaaggacagaaaatgtttgagaaacttgaaaagtcaccaaagcctgttgttgccgccatcagtggatcctgcttgggaggcggacttgagcttgccatagcatgtcaatacagaatagcaacaaaagacagaaaaacagtattaggtgtccctgaagtgttgctgggaatcttaccaggagccggaggtacccagaggctgcccaaaatggtgggtgtgcctgctgcttttgacatgatgctgactggtaggaacattcgtgcagacagagcaaagaaaatgggactggttgaccagttggtggacccgctaggaccaggaataaaatctccagaggaaaggacaattgaatacctagaagaagttgcagttaattttgccaaaggcctggctgacaggaaggtctctgcaaagcagagcaaaggcctgatggaaaagctgacatcgtatgccatgactatcccactttgtctgactacaacattcaaaacagtggaagaaaaagtgaagaagcagaccaaaggcctttaccctgcacctttgaagataattgacgctgtgaagactggacttgagcaaggaaatgatgctggctatcttgccgaatcagagaaatttggagagcttgcattgaccaaagaatcaaaagccctgatggggctttataatggccaggtcctgtgcaagaaaaataaatttggagcgccacagaagactgttcagcagctagccatccttggcgcagggctgatgggggctggcattgcccaggtctctgtggacaagggactgaaaactcttcttaaagacactacagtgacagggctgggccggggacagcaacaagtgttcaaaggactgaatgacaaggtaaagaagaaggcactcacatccttcgaaagggactccatcttcagcaacctgatcgggcagctcgactacaagggcttcgagaaggctgacatggtgattgaggctgtcttcgaggacctcgctgttaagcacaaagtgttaaaggaagtggaaagcgtgactccagaacactgtatcttcgccagcaacacatctgctctcccaatcaatcaaattgctgctgtgagccaaaggcctgagaaggtgatcggcatgcactacttctctcctgtggacaagatgcagcttctagagatcatcacaactgacaaaacctccaaggacaccacagcgtctgccgtggccgtgggtctcaagcaggggaaggtcatcattgtggtcaaggacggacctggcttctacaccaccaggtgtcttgctcccatgatgtcagaagtcataagaatcctccaggaaggagttgaccctaagaagctggacgccttgaccacaggcttcggcttccctgtgggtgctgccaccctggcagatgaagtagggatagatgtagcacagcacgtagcagaagatctaggcaaagccttcggggagcggtttggaggtggcagcgtagaactgctgaaactgatggtctccaagggcttcttgggtcgcaagtctgggaagggcttctacatctatcagtcgggctcaaagaataagaatttgaattctgaaatagataatatcttggtaaacctgaggctgcctgccaagcccgaggtctcctctgatgaagacatccagtaccgtgtgataacaaggtttgtgaatgaggcagtcctgtgcctacaggaagggatcctagccacgcctgaagagggagacatcggagcagtctttgggcttggctttcccccttgtctcggagggcccttccgctttgtggatctgtatggtgctcagaaggtagtggaccggctccggaagtatgagtctgcctatgggacacagtttaccccgtgtcagctactccgcgaccttgctaacaactctagcaagaagttctaccagtgagcaggccgtcccgccctgcccctccacccacgtactaacccagacccggcagtgctgcttctcagccgcgctgtctaaattatcaggaagcaggagaaagaccgaggctagccttggatttgctcctccatgatagtgccttcagccctgtcccgctcttcctcctggtgaagtctgactgtgaattaaatgtttgtacttcatgttggggggtgagccccactgtgcttcttttgcaagccctgcctgagaccccgatcagcagcctagagtaacccagaacacctgctgcctgtgccttccgggaggccagtggggcctggggtgccgagggcattttcgcaccaagccaaacacaggataacattaaaatccagactgtcggcctctgccagcctggtctgttttcctctgcctgcccttgtgtttgagcacccccatcagtaataaagccctgtgctctgagcat

SEQ ID NO: 4162 - DNA, 4160 bp, Rattus norvegicus
  Genbank Accession No. NM_130894
cgcgaggccgggaaggtgaagttcagacaggtggagtcaacaccatcagtagccaatctggacctgaatcggcacagaggagacctcaagttcttttcatctttttgactccagccatgtccatgatgcccaacctgtgaaggtcccttaccagctagaaacgagatgtccctgctcttttctcgatgcaactccatcgtcaccgtcaagaaggataagcgacacatggctgaggtgaatgcttcccctctcaagcactttgtcactgccaagaaaaagatcaatggcatctttgagcagctgggggcctacatccaagagagtgccggcttccttgaagacacccacaggaatacagaactggacccagttactacagaagagcaggtcctggatgtcaaagggtactgtccaaggtcaggggaatcagcgaggtgctggccaggcggcacatgaaggtggctttttttggccggacgagcaatgggaagagcaccgtgatcaatgccatgctttgggacaaagttctgccatctgggattggccacaccaccaattgcttcctgcgggttgggggcacggatggccacgaggccttcctcctcacggagggctcagaagagaagaagagtgtcaagaccgtgaaccagctagcccatgccctccatcaggatgagcagctgcatgcaggcagcctggtgagtgtgatgtggcccaactccaagtgtccacttctgaaggatgacctcgtgctgatggacagccctgggatcgatgtcaccacggagctggacagctggattgataagttttgcctggatgctgatgtgtttgtactggtggccaactcagagtccacgctgatgcagacggagaagcagttcttccacaaagtgagtgagcgtctctcccggcccaacatcttcatcctgaacaaccgctgggatgcgtctgcctcggagcctgagtacatggaggaggtgcggcggcagcacatggaacgctgcaccagctttctggtggatgagctaggcgtggtggatcgagctcaggccggggaccggatcttctttgtgtctgccaaggaggtgctcagtgccagggtccagaaagcccagggcatgccagaaggaggtggcgctcttgcagaaggttttcaagtgaggatgtttgagtttcagaatttcgagaggcgatttgaggagtgcatttcccagtctgcagtaaagaccaaatttgagcagcacacagtccgggccaagcagattgcagaggccgtccgtctcatcatggattccctgcacattgcggctcaggagcagcgggtttattgtcttgaaatgcgggaagagcggcaagaccggctgagattcattgacaagcagctggagctcctggctcaagactataagctacggattaagcagatgacagaggaagtggaaaggcaggtgtccacagccatggctgaagagatcaggcgcctctctgtgctggttgacgagtaccagatggactttcacccatccccagttgtcctcaaggtttataagaatgaactgcaccgccatatagaggaaggcctgggacgaaacatgtctgaccgctgctccacagccattgccagttcactgcagactatgcagcaagacatgatagacggcttgaagccccttcttcctgtgtctgtgcggaatcagatagacatgctggtccctcgacagtgtttctccctcagctatgacctgaactgtgacaagctgtgcgctgactttcaggaggacatcgaattccatttctcccttggatggactatgctagtgaataggttcctgggccctaagaatagccggcgggccttgctgggctacaatgatcaggttcagcgtcctctccctctgacacctgccaaccccagcatgccacccttgccacagggctccctcacccaggaggagctcatggtctccatggttactggcctggcctctctgacttccaggacctctatgggcattctcgtggtcggaggagtggtgtggaaggcagtgggctggagactcatcgccctctcctttggactgtatggcctcctgtacgtgtatgagcggctgacctggaccaccagagccaaggagagggccttcaagcgccagtttgtggagtatgccagtgagaagctgcagctcattatcagttataccggctctaactgcagccaccaagttcagcaagaattgtctgggacatttgctcatctgtgccagcaagttgacatcacccgggataatctggagcaggaaattgctgccatgaacaagaaagttgaggctctggattcacttcagagcaaagccaaattgctcaggaataaagctggctggttggacagcgaactcaacatgttcatacaccagtacctgcagcccggcagatagtgggcagccagggcggacctgcaccgagaagagacagggccgcacctcccatcagctctagtccttggctgctgcagagagaaggaaagcacccactgtcttgtaccagttactccctaccccctgcaggaagacccccagctcatacccagtggagaccaacaaggactggacagctcagccccaaggagtcatgcatgtgtctgtgtctgctcatcatgctcagtcggttggaagtcactgtgcatttgataaggtcttcctcaggatgccatcctgcagaacgactgatgggcgccttcacaggcatcaggcaggcactcctttcagcccgagtacacctacagagagagaatgttgggggtgactggactccccagaaaagttcagggtactgaagaacttgtgtcttgcatttggccctcagctttagcactttttcccacttgcagagtctttcagttgtgcttggtggccaggctcacacaccctgggctttagactcaaccagcttatagggaaagctggagacccttgccagccagagcaaagtaagagctcaggggacggtatgtgaactagggtgtccgatgtggtagtgaggttggtgtctggcattgtgatgacaagggactcgcctcccttcttgcaagtttgctccaggtggttaaaggatgttgcaggaggaatggtggaagatgggagctgcccgggttagtacagaagaggtctctctatctgacctagcactgagtggctcacaaacctgtaaggctcaccttgctaatttgagctcatccctgccttggtacaagctccctgtggccaccgttctctggactggattgtgccgatgactgcagctggttacaaaacgacaggagaagcctggcggctgttctccttctgccccaaccctcaagcctcctcctcttctgctcctgaagcctcctgctgcttgcttcgcctcatgtcaacgctgaacttcttactgttaagtgttgaaattgttaatggtcaaaacagggaggatttcagtcaccaaggttgattgtcttggaagagcagttttagagtgatgaatcctttgtaggacaggtagagttagagataaagcactgggctccagcccctcccagaagcccacaaccaggagctctctgtgggacccatgggccatgtcctctcctgcccatgcctgtgtgtcacttcccctcagtctaccctttgtgctgggacagtgctggtcttggccaaggtcagcgtgaatggaaagacatagtgcattgccaggctggacggggtcatctcacagtgggtcattgccaggctggacggggtcatctcacagtgggtcaggacacatcagtgtcgtgtaatcccaatgagtgttatgtgctttttttttggggggggggtagaataaactcaaattctttttctgtatagcccttgagtaatgaatggaattttgagcttatataagtaaagattcatttataccaccagggagagcctgtatctgagagacgtttagcagagagcactttagtttcttgctgctaattgttgtgtgatcctttgctggggtgtagaaggcaccagacacagtgtgtttgcttctggtatatataggtgatgcatctgcctgggttacttgtatctctgccgatagtattggaacctaaaataaagccccagttgtgaccctgaaaaaaaaaa

SEQ ID NO: 4163 - DNA, 672 bp, Rattus norvegicus
  Genbank Accession No. NM_131910
cccggagtgttggtgattcggagctgctgtgtctgtccgagatggcagaggtggaggaaacactcaagaggcttcagagccagaaaggagtgcagggcatcatcgtggtgaacacagaaggcattcccatcaagagcacaatggacaatcccaccacgacacagtacgccaacctcatgcacaacttcatcttaaaggctcggagcactgtgcgtgagattgacccccagaatgacctaaccttccttcgaattcgctccaagaaaaatgaaattatggtggcaccagataaagactatttcctgattgtgattcagaatccaactgaataaggcactgtcttggcttcctgtgtcattccttaatttaacgtcccccgagaataatagcgttaatcatgtcagtgggcacatgtggctgcctggagccatgcagaccttggcattggtgaagggcagctctgcccaccccaccaaggagtgcctctgatgatccggtcagtccccagaagagctcagttctctctccaggctttggaatgagagctcttgatgagcccacagccagcttccttctaaccttcatttcactttgtcccccttggaagctgtttttgtttttttaaactaaaaataacttcaaccccaaaaaaaaaagaaaaaaaaaaaaaaa

SEQ ID NO: 4164 - DNA, 1376 bp, Rattus norvegicus
  Genbank Accession No. NM_133283
gggggtgccgcgccggccgcagagccctgatgctggcccggaggaagccggtgttaccggcactcaccatcaaccctaccatcgctgagggcccgtcccccaccagcgagggcgcctccgaggcacacctggtggacctccagaagaagttggaagagctggacctggatgaacagcagaggaagcggctggaggccttccttacccagaaggccaaggttggtgagctcaaggacgacgactttgagagaatctcagaactgggtgcaggcaatggcggcgtggtcacaaaggcccggcataggccctctggcctcatcatggccagaaagctgatccacctggagatcaagccagctgtccgcaaccagatcatccgggagctgcaggtgctgcatgagtgcaactcaccgtacatcgtgggcttttatggggccttctacagcgacggcgagatcagcatctgcatggagcacatggacggtggctcactggaccaggtactgaaggaggccaagcgcattcccgaggacatcttagggaaggtcagcattgcggtgctccggggcctggcgtacctccgcgagaagcaccagatcatgcatagagatgtgaagccctccaacattctggtgaactctcgtggagagattaagctgtgcgacttcggagtgagcggccagttgattgactccatggccaactcatttgtagggacacgctcctacatgtccccagaacggctgcagggcacccactactctgtgcagtcggacatctggagcatggggctgtcgctggtggagctggccatcgggaggtaccccatccccccacctgatgccaaggaactagaggccagctttggccggcctgtggtggacggggcagatggagagccccatagtgtctcaccgcggccccggccccctggacgccccatcagtggtcatgggatggacagccgaccagccatggccatctttgagctgctggactacatagtgaatgagccacctcccaagctgcccagtggtgtgttcagctcagacttccaggagtttgtgaataaatgtctcattaagaacccagcagagcgtgcagacctcaagctgctgacgaaccatgccttcatcaaacgctctgagggggaggacgtggacttcgctggctggctatgcagaaccctgcggctgaagcagcccagcacacccacgcgtactgcagtgtgacagccatcgctcagcagtctgtgtccttgtcctgtggcacagcggccgcctttggggacagcagtggtgtgtgttgtggcaggggacctgtgcctgtgcatttggaaaagcaaacaaagtggagaaagagagaaaaaaaaaaaa

SEQ ID NO: 4165 - DNA, 963 bp, Rattus norvegicus
  Genbank Accession No. NM_133290
atggatctctctgccatctacgagagccttatgtcgatgagccatgacctgtcacccgaccacggaggaactgagtcctccggaggactttggaacataaactcatcggactccatcccatctggggtcacctctcgcctgactggccgctccactagcctggtggagggccgaagctgcagctgggtacccccaccccctggtttcgcacccttggctccccgcccgggccctgagctgtcaccctcacctacttcgcctactgcaactcccaccacctcctctcgatacaagactgagctctgtcggacctactcagagagcgggcgttgtcgctatggggccaagtgccagtttgcccacggcccgggtgaactgcgccaagccaatcgccaccccaagtacaaaacggaactctgccacaagttctacctccagggccgctgcccctacggctctcgatgccacttcatccacaaccctaccgaggacctggctctccctggccagccccatgtgctccgacaaagcatcagcttctcaggcttgccttcaggccgcagaacctcaccaccacctccaggcttctctggcccttccctgtcctcttgctccttttcgccttccagctccccaccaccgcctggggaccttccactttccccttctgccttctctgctgcccctgggacccctgtgtctcgaagagaccctaccccagcctgttgtccctcctgccgaaggtctactacccctagcaccatctgggggcccttgggtggtctggctcggagcccatctgcacactctctgggatccgaccctgatgattacgccagcagcggcagcagcctgggtgggtcagactcgcctgtctttgaggccggggtgtttgggcctcctcagccccctgcacccccaaggcgtcttcccatcttcaatcgcatctctgtctctgagtga

SEQ ID NO: 4166 - DNA, 1935 bp, Rattus norvegicus
  Genbank Accession No. NM_133295
caaaggaacaaatagcccacagatccgcagaacccttgtccttccacaatgcgcctctaccctctggtctggctttttcttgctgcgtgcacagcttgggggtacccatcctcaccacctgtggtgaacactgttaaaggcaaagtcctggggaagtatgtcaatttggaaggatttgcacagcctgtggctgttttcctgggaatccccttcgccaagccccctcttggctccttgaggtttgctccaccacagcctgcagagccttggaactttgtgaagaatactacctcctacccacctatgtgctctcaagatgctgttggagggcaggttctctcagagcttttcaccaacaggaaggaaaacattcctttacagttttctgaagactgcctctacctgaacgtttatactccggctgacttgacaaagaacagccggctaccagtgatggtgtggatccatggaggtggactggtagtgggtggagcatccacctatgatggacaggtcctctctgcccatgaaaatgtggtggtggtgaccattcagtatcgccttggcatctggggattcttcagcacaggggatgaacacagccggggcaactggggtcacttggaccaggtggctgcactacactgggtccaggacaacattgccaactttgggggtaacccaggctctgtgaccatctttggagaatctgcaggaggtttcagtgtctctgctcttgtgttatctcctctggccaagaacctcttccacagggccatttctgagagtggtgtggtcctcacttctgctctgattacaacagatagcaagcccattgctaagctgattgctacactttctgggtgtaaaaccaccacatcagctgttatggttcattgcctgcgccagaagacagaggatgaactcctggagacttcattaaaattgaatcttttcaaactggacttacttggaaacccaaaagagagctatcccttcctacctactgtgattgacggagtggtgctgccaaagacaccagaagagatcctggctgagaagagtttcaacacagtcccctacatagtgggcatcaacaagcaagagtttggctggatcattccaacgcttatgggctatccactctccgaaggcaaactggaccagaaaacagccaaatccctcttgtggaagtcctacccaacactgaaaatctctgagaaaatgattccagtggttgctgagaagtacttcggagggacagatgaccctgccaaaaggaaagacctgttccaggacttggttgcagatgtgatatttggtgtcccatcagtaatggtgtctcgaagtcacagagatgctggagcccccaccttcatgtatgaatttgagtatcgcccaagctttgtatcagccatgaggcccaagacagtgatcggagaccatggtgatgaactcttctcagtatttggatctccatttttaaaagatggtgcctcagaagaggagaccaatctcagcaaaatggtgatgaaatactgggccaactttgctcggaatgggagccctaatgggggagggctgccccattggccagaatatgaccagaaggaagggtacctgaagattggtgcctcaactcaggcagcccagaggctgaaggacaaagaagtggctttttggtctgagctcagggccaaggaggcagcagaggaaccatcccactggaaacatgttgagctctgatcaggagggtcagccatgtttgagaacctgaagctaaaggggaattattccacagaagattttgtaaagacataacacttcttgtctttgagactataacatcacatggtattttgtacaaatgcattaaagggaaaatacttaaccttattgcttcaacttgtaaaataaaacattgtttagaaattc

SEQ ID NO: 4167 - DNA, 2320 bp, Rattus norvegicus
  Genbank Accession No. NM_133298
gtatttcataaaacagagaggatcgcaggaggccggcactctgactcctggtggatgggactagggagtcagagtcaagccctgactggctgagggcgggcgctccgagtcagcatggaaagtctctgcggggtcctggtatttctgctgctggctgcaggactgccgctccaggcggccaagcggttccgtgatgtgctgggccatgagcagtatccggatcacatgagggagaacaaccaattacgtggctggtcttcagatgaaaatgaatgggatgaacagctgtatccagtgtggaggaggggagagggcagatggaaggactcctgggaaggaggccgtgtgcaggcagccctaaccagtgattcaccggccttggtgggttccaatatcaccttcgtagtgaacctggtgttccccagatgccagaaggaagatgccaacggcaatatcgtctatgagaggaactgcagaagtgatttggagctggcttctgacccgtatgtctacaactggaccacaggggcagacgatgaggactgggaagacaacaccagccaaggccagcacctcaggttccccgacgggaagcccttccctcgcccccacggacggaagaaatggaacttcgtctacgtcttccacacacttggtcagtattttcaaaagctgggtcagtgttcagcacgagtttctataaacacagtcaacttgacagttggccctcaggtcatggaagtgattgtctttcgaagacacggccgggcatacattcccatctccaaagtgaaagacgtgtatgtgataacagatcagatccctatattcgtgaccatgtaccagaagaatgaccggaactcgtctgatgaaaccttcctcagagacctccccattttcttcgatgtcctcattcacgatcccagtcatttcctcaactactctgccatttcctacaagtggaactttggggacaacactggcctgtttgtctccaacaatcacactttgaatcacacgtatgtgctcaatggaaccttcaactttaacctcaccgtgcaaactgcagtgccgggaccatgcccctcacccacaccttcgccttcttcttcgacttctccttcgcctgcatcttcgccttcacccacattatcaacacctagtccctctttaatgcctactggctacaaatccatggagctgagtgacatttccaatgaaaactgccgaataaacagatatggttacttcagagccaccatcacaattgtagatggaatcctagaagtcaacatcatccaggtagcagatgtcccaatccccacactgcagcctgacaactcactgatggacttcattgtgacctgcaaaggggccactcccacggaagcctgtacgatcatctctgaccccacctgccagatcgcccagaacagggtgtgcagcccggtggctgtggatgagctgtgcctcctgtccgtgaggagagccttcaatgggtccggcacgtactgtgtgaatttcactctgggagacgatgcaagcctggccctcaccagcgccctgatctctatccctggcaaagacctaggctcccctctgagaacagtgaatggtgtcctgatctccattggctgcctggccatgtttgtcaccatggttaccatcttgctgtacaaaaaacacaagacgtacaagccaataggaaactgcaccaggaacgtggtcaagggcaaaggcctgagtgtttttctcagccatgcaaaagccccgttctcccgaggagaccgggagaaggatccactgctccaggacaagccatggatgctctaagtcttcactctcacttctgactgggaacccactcttctgtgcatgtatgtgagctgtgcagaagtacatgactggtagctgttgttttctacggattattgtaaaatgtatatcatggtttagggagtgtagttaattggcattttagtgaagggatgggaagacagtatttcttcgcatctgtattgtggtttttatactgttaatagggtgggcacattgtgtctgaagggggagggggaggtcactgctacttaaggtcctaggttaactgggagaggatgccccaggctccttagatttctacacaagatgtgcctgaacccagctagtcctgacctaaaggccatgcttcatcaactctatctcagctcattgaacatacctgagcgcctgatggaattataatggaaccaagcttgttgtatggtgtgtgtgtgtacataagatactcattaaaaagacagtctattaaaaaaaaaaaaaa

SEQ ID NO: 4168 - DNA, 1189 bp, Rattus norvegicus
  Genbank Accession No. NM_133299
gatagtcacgtggccgcagactgctagcgctctgctacttctaaggaagccaaggtctgactttagcgagacctgaaggacagactctctgctgcgatgggctcttggaagagtggtcagagctacctagcggccgggttgctgcagaaccaagtggcggtggtcaccggcggggccacaggcattggaaaagccatctcccgggagctcctgcacctggggtgtaacgtggtcattgcttcccggaaactggacagattaaccgctgctgtggatgaactgagagcctctcagcctccctccagcagcactcaagtcaccgccatacagtgcaatatcaggaaagaagaagaggtgaataatttggtcaaatctaccttagctaaatatgggaagatcaacttcttggtgaacaacgcagggggccagttcatggctcctgctgaagacatcactgcgaagggatggcaagctgtgattgaaaccaacctgactggcaccttctacatgtgcaaagcagtttacaattcctggatgaaagaccatggcggctctattgtcaatatcattgtccttcttaacaacgggtttccaacagccgcgcacagtggagcggcaagagcaggtgtttacaacctcacgaaaaccatggctttgacgtgggccagcagcggagtgaggatcaactgtgttgctcctgggaccatttactcccagactgctgttgacaactatggcgaactgggacagaccatgtttgagatggccttcgagaatatcccagctaagcgtgttggactccccgaggagatctcccctctggtgtgcttcctactgtcccccgcagcatccttcatcactggacagttaatcaatgtggacggaggccaggctctgtacactcgcaacttcacgataccagatcatgacaactggcctgtgggagctggggactcttcttttatcaagaaggtgaaggaatctttgaagaagcaagccaggctctaagccaaggagacagccacccattgtgtttcctgcgtgccttaacgtcctgagaatgttcgtacttcataagaacttacgatttctgtgggggaaaatcactttaatgttaatagttttatctttgtaaaaaactactcccaaaataaatgtatcttcatgttcaaaaaaaaaaaaaaaaaaa

SEQ ID NO: 4169 - DNA, 2909 bp, Rattus norvegicus
  Genbank Accession No. NM_133307
gaattccggggcggcggccgcggggatcccgcgagcggcccctgaacatctacccttcttgccgggacccgggaggtccccactggcctccgggcccgtcctgatcagactcgtgtcgacctccccgtccacgcgcatccgggagagccgcgccacgagacggacccgggcccgccgggacccctggtgtctggccctgcgtcgagaggctggtgactgccacccataagctccagcttcagcctcggcttactcccctcaggggcttgcaggctgaggcctgccctcggacgcggctgaccagcctctccctctcttccacactttggacttctctttggacctcctaaaaaggctccatcatggcaccgttcctgcgcatctccttcaattcctatgagctgggctccctgcaggcggaggacgacgcaagccagcctttctgtgccgtgaagatgaaggaggcactcaccacagaccgagggaagactctggtacagaagaagcccaccatgtaccctgagtggaagtcaacattcgacgcccacatctatgaaggccgtgtcatccagatcgtgctgatgcgggcagctgaagaccccatgtcggaggtgaccgtgggcgtgtcagtgctggctgagcgctgcaagaagaacaacggcaaggctgagttctggctggacctgcagcctcaggccaaggtgctgatgtgtgtgcagtatttcctggaggatggggattgcaaacagtccatgcgtagtgaggaggaggccatgttcccaactatgaaccgccgtggagccattaaacaggccaagattcactacatcaagaaccacgagttcatcgccaccttctttgggcagcccaccttctgttctgtgtgcaaagagtttgtctggggcctcaacaagcaaggctacaaatgcaggcaatgcaacgctgccatccataagaaatgcatcgacaagattatcggccgctgcactggcactgctaccaatagccgggacaccatcttccagaaagaacgcttcaacatcgacatgcctcaccgattcaaggtctataactacatgagccccaccttctgtgaccactgtggcactttgctctggggattggtgaaacagggattaaagtgtgaagactgcggcatgaatgtgcaccacaaatgccgggagaaggtggccaacctgtgtggtatcaaccaaaagctcttggctgaggccttgaaccaagtgacccagaaagcttcccggaagccagagacaccagagactgtcggaatataccagggattcgagaagaagacagctgtctctgggaatgacatcccagacaacaacgggacctatggcaagatctgggaggggagcaaccggtgccgccttgagaacttcaccttccagaaagtacttggcaaaggcagctttggcaaggtactgcttgcagaactgaagggcaaggaaaggtactttgcaatcaagtacctgaagaaggacgtggtgttgatcgacgatgacgtggagtgcaccatggtggagaagcgggtgctggcgctcgcctgggagaatcccttcctcacccatctcatctgtaccttccagaccaaggaccacctcttctttgtgatggagttcctcaatgggggcgatctgatgttccacattcaggacaaaggccgcttcgaactctaccgggctacgttttatgcagctgagatcatctgcggactgcagtttctacatggcaaaggcatcatttacagggacctcaagctagacaatgtaatgctggacaaggatggccacatcaagattgctgacttcgggatgtgcaaagagaatatatttggggagaaccgggccagcacattctgcggcactcctgactacatcgcccctgagatcctgcagggcctgaagtactcattttccgtggactggtggtcttttggggtcctcctctatgagatgctcattggccagtcccccttccatggtgatgatgaggacgagctctttgagtccatccgggtggacacaccacactacccgcgctggatcaccaaggagtccaaggacatcatggagaagctcttcgagagggaccctgccaagaggctgggagtaacaggaaacatcaggcttcacccctttttcaagactatcaactggaacctgctggagaagcggaaggtggagccgccctttaagcccaaagtgaaatccccttcagactacagcaactttgacccagagttcctgaatgagaaaccccaactttccttcagtgacaagaacctcatcgactctatggaccagacagccttcaagggcttctcctttgtgaaccccaaatatgagcaattcctggaatagtgagctcccagacctgcttttaatgccccggcagagtaggcccatctgccctggtttgcatcctcactgcccatgaagaagagtgggtgactggtgattcctgctgctgccccctcttcctcggagagtctggctcctgttggctgggctcacagtacttcctctgtgaactgtttgtgaatttgccttccttttgccatcggagggaaactgtaaatcctgtgtgtcattacttgaatgtagttattgaaatatatattatatatatgcacatatatataataggctgtatatattgctcagtatagaaagcatgtaggagactggtgatgtgttgacctttttttaaaaaaaaccatatgtatacgtgtgtatgtatacatctacacacgtatacatatatgtatgtatgtatgtatgtatgtatgtatatatgaccaaaagaaaagagagcacaagctacctgaaccacaggattgtttatgtgtgtataaataaacactgaatggtaaaaaaccggaattc

SEQ ID NO: 4170 - DNA, 2641 bp, Rattus norvegicus
  Genbank Accession No. NM_133309
gccctggaagccctgctttcctgacaccctacaggactcacaggcaggccatggcagctctggcagcgggagtatccaagcaacgtgcagttgctgaggggcttggctctaaccagaatgctgtgaagtatctgggccaggacttcgagaccctgaggaagcagtgcttgaactcgggggtcctatttaaggacccagaatttccagcatgtccatcagctttgggctacaaggatctaggaccaggctccccagacactcaaggcatcgtatggaagcgacccacggaattgtgtcccaaccctcagtttattgttggtggagccacacgcacagacatccgccaagggggtcttgtgtgggcacatgcgtctttgtgattctctgctggagaaacctgaacatgggctgaactgtaggactcccttgatggtccaagagactgctggcttctagcagccattgcctccctcaccttgaatgaaaagctgctttaccgggtgcttcccagggaccagagcttccagaaggactacgcgggcatatttcatttccagttctggcagtatggagagtgggtggaggtggtcattgatgaccggctccccaccaagaacgggcagctgctttttctacactccgaagaaggcaatgagttttggagcgctctgctggagaaagcctatgccaagctaaatggttcatatgaggctcttgttggaggctccacaatcgaggggtttgaggatttcacaggtggcatctctgagttttatgacttgaagaagcctccggaaaatctgtactacatcatccagaaggccctccgcaaaggctctctgctgggctgctccattgatgtctcaactgcagctgaagcagaagccaccaccaggcaaaagctggttaagggtcatgcatactctgttactggagtcgaagaggtgaatttccatggccgtccagagaagctgatcaggttgaggaacccgtggggtgaagtggagtggtcgggagcctggagtgataatgcacctgagtggaattacatagatccaaggaggaaggaggagctggacaagaaagcagaagatggcgagttctggatgtccttttcggatttcttgaagcagtactcccgactggagatctgcaacctgtccccagactctctgagcagtgaagagatacacaaatggaacctagtactcttcaacggccgctggacacggggttctacagccgggggctgcctgaactacccaggcacgtactggaccaacccccagtttaaaatccatttggatgaggtggatgaggaccaggaggagggcaccagtgaaccctgctgtaccgtgctgctgggtctgatgcagaagaatcgaagacgtcaaaagaggatcggccagggcatgctcagcataggctacgctgtctaccagattcccaaggaggttctcagcacgatcaggagtgtaaatagaccagcagggtccagattcatagacttgggcccaggctatgttcccagattgcagactactggtctgtcctgcccttggatcacagatgcacgccacttatcatggaggggacggcccagttggagagtcacacggatgcacaccttggccgggacttcttcctgggacgccagccctctacctgctccagcacttacatgaaccttcgggaggtgtccagcagggtccgactccccccgggacagtacctggtggtgccatccaccttcgagcccttcaaggatggtgacttctgcttgagggtgttctcagagaagaaggccaaggctctggaaattggggatactgtatctggacaccctcatgagccacatccccgtgacatggatgaagaagatgaacatgtccggagcctgtttgaggagtttgtgggcaaggattctgagatcagtgctaatcagctcaagagggtcctgaatgaagtactttctaaacgaacagacatgaaatttgatggattcaacatcaacacttgcagagaaatgatcagcctgctggatagtgatgggacaggaagcctgggacctatggagttcaagactctctggctgaagatccgcacatatctggagatcttccaagaaatggaccataaccatgtagggaccattgaagcccatgagatgaggacagctctcaagaaagcaggtttcaccctcaacaaccaggtgcagcagaccattgccatgaggtatgcgtgcagtaagcttggtgttgacttcaacggttttgtggcgtgtatgatccgcctggagaccctgttcaaactgttcaggcttttggataaggaccagaatggcattgtccagctctccctggctgagtggctgtgctgtgtgctggtctgacccgctgtttggacatcaacaacttccctgtctcccacttgtccctttcagtcttatgaacatgtgacctcaggtggcatttactgactgttgtattgttccagccaactgttgttcctgagacactgcctttcccaacagagcagtctagggagccccagatctctcagcagcaccgagctatgagctaactgggcagatcccagggttcagcagaaggaaaagaatcaattaaagttgtgggccagg

SEQ ID NO: 4171 - DNA, 2129 bp, Rattus norvegicus
  Genbank Accession No. NM_133315
gaggccgctcgagagcaggcttagggtctactgcggccggtggaccctccaacccgcttccataaggctttagctttccaacttcagctacagtgttagctaagtttggaaagaagacataaagaagaccccggtgggcagctttgctgttctttgccttagttgtcctttggggtctttcggcacaaggctgctgtgcttatagccgtgctatctccggttcctcacactcctgtgaagaagccctgggcaagagcagctaaagctactagcatccgaacaaacaaggggagagcgtctggtgccatgaccaagtcaagagatcagacccatcaggaaggatgctgtggatctttagcaaactacctgacctcagcaaaattcctcctctaccttggccactctctctccacttggggggatcggatgtggcactttgcagtgtctgtgtttctggtggaactctacggaaacagcctcctcttgacagctgtctacgggttggtggtggcaggctctgttctggtcctgggagccatcattggtgactgggtggataagaatgccagacttaaagtggcccagacgtccctggtggttcagaatgtatcagtcattctctgcgggatcatcctgatgatggttttcttacacaagaatgagcttctgaacatgtatcatggatgggtccttactgtctgctacatcctgatcatcaccattgcaaacattgcgaatttggccagtactgccactgcaattacaatccaaagggactggattgttgtcgtagcaggagaaaacaggagcagattagcagacatgaatgctaccattagaaggattgaccagctaaccaacatcctggcccccatggctgttggccagattatgacattcggttccccagtcattggctgtggtttcatttctggttggaatttggtgtccatgtgtgtggagtacttcttgctctggaaggtttaccagaagacccctgctctggctgtaaaagctgctctcaaggtagaggagtcagaactgaagcagctgacctcacctaaagatacggagccaaaacctttggagggaactcacctaatgggtgagaaagactctaacatccgtgaacttgaatgtgaacaagaacccacctgtgcctcccagatcgcagaacccttccgcacttttcgagatggatgggtctcctactataaccagcccgtatttttgggctggcatgggcctggctttcctctatatgacagtcctgggcttcgactgtatcgccacagtatatgcttacactcagggactgagtggttccatcctcagtgttttgatgggagcatcagcaataactggaataatgggaactgtggccttcacttggctacgtcgaaaatgtggccttgttcggactggtctgttctcaggactggctcagctttcttgtttgatcttgtgtgtgatctccgtgttcatgcctggaagccccttggacctgtctgtttctccatttgaagatatccgttctaggtttatacatgaggaggcagtgtcctcaactaccaaaatacctgaaacggaaatgcttatgtctaatgtgtctaatgttgtcaataccgtccatgagatgagtactaaatccgtccccataatctccgtcagcctgctgtttgcaggagtcattgctgctagaatcggtctttggtcctttgatttgactgtgacacagttgctgcaagaaaatgtaattgaatcagaaagaggcattatcaatggtgtgcagaactccatgaactaccttctcgaccttctgcatttcatcatggtcatcttggccccaaatcctgaagcttttggcttgctagtattgatttcagtcycctttgtggcaatgggacatcttatgtatttccgttttgcccsgaagactctgggcaaccagatttttgtttgtgctcctgatgaaaaggaagttacagatgaaagtcagcctaatacatctgttgtgtaaaatagtttagctgtggcccctgttactagatttgtggagagcatgtgtgcttattttgtactacagaattccaataaatgcctgcacttttaaaaaaaaaaaaaaaaaa

SEQ ID NO: 4172 - DNA, 2243 bp, Rattus norvegicus
  Genbank Accession No. NM_133320
cggccgcgtcgaccggcggcgaacatgcgcttttgacacattggcggctttcttgatcatggatggtgaagatataccggatttttcaagtttaaaggaagaaactgcttattggaaggaactttccttgaagtataagcaaagcttccaggaagctcgggatgagctagttgaattccaggaaggaagcagagaattagaagcagaattggaggcacagttagtacaggctgaacaaagaaatagagacctgcaggctgataaccaaagactgaaatacgaagtggaggcgttaaaggagaaactagagcatcagtatgcacagagctataagcaggtctcagtgttagaagatgatttaagtcagacccgggccattaaggagcaactgcataagtatgtgagagagctggagcaggccaatgatgacctggagcgagcaaaacgggcaacaatagtttcactggaagactttgaacaaaggctaaatcaggccattgaacgaaatgcatttttagaaagtgaacttgatgaaaaggaatctttgttggtctcagtacagaggttaaaggatgaagcaagagatttaaggcaagagctagcagttcgggaacggcaacaggaagtgacccgaaagtctgctcccagctctccaactctggactgtgagaagatggattctgccgtccaggcttcgctctccttgcctgcaacgcctgtggggaaaggcacagaaaacagttttccttcaccaaaagctataccaaatggctttggaaccagtccactaactccttctgctaggatatcagcactaaacatcgtgggagatctcttgcggaaagtaggggctttagaatccaagttagcagcttgcaggaactttgcaaaagaccaagcatcccgaaaatcctatgttccagggagcgttaactgtggggtaatgaacagcaacggtccagagtgcccaaggtcagggcgtgcaactttcttccataaaggggcagtaaacggctttgatccagctcctcctcctcctgggctgggctcctcacgcccatcgtcagcaccgggtatgctgcctctcagtgtgtgagtgcccggcctccaggtggggcccctgccttcttccagcagcccaggacacmtacgcctcgtccctcggtgcctgggtccagccctgtgcccctctgtctgcctcttcaccgctggcagagggcaggctgcatgcagtggccgctgctgggccctgcccagccccaggactctgcgcgatatcaatactggctattttctcttctcgccgtagtgccgttggtttcacatgattgcacttttgtgggtcccaagtgatacacacatacatacgtgtgtttctcgatcactggatgtggaagcacccgttcatcacatctgcctcatagcccccatattgctgtgctgataggatttagttgtgtttaggacattgcagatcttctagaagtttccctcaatcaggttggtaaggccttctaagctcctgccaagcatcttcagtgctcacaatcatgtgtccccagcctcacccctgcagtcaggaacgtctctgaattacggaacactgtctgtaccttctggctttatgtaagcagtccattccattgcttgtttctcaaagcagcgagatgcctgtctgagctgcaagaggcaggggcagctgagacatgggcactccagggctgagcctctgtgctgccctctcctctgtgcctcagactcaggaggcaggtggcagccttcttgccagctttccaggccctcaggtcagtgacatctctcagagcggttttgttttttttttttttttttcttctcctctgaagggccatcaagttgcactggggagggttgaggggcccgattgtgggctggcggtgtcagctcttgggcacagactggctagaggtgtttgtcccttgcaccctttggctattctcatgctgcacttactgtttacatttgttttactgtacataggtttgtaaacattattgcctaagatatttgtatataacttgggctttgtagcttttatttattcagactcatatggcatgttaattaatgacttacgatggtgtccgactctgggcagctggataggatcatcatgtggttaacagaagatacttccctccaaaaaatcttttaatgtggaaacaataaatttcacagaaaacaaaaaaaaaaaaaaaaaaaaa

SEQ ID NO: 4173 - DNA, 2817 bp, Rattus norvegicus
  Genbank Accession No. NM_133323
taagtgaagtgagaacctggattattctgtggccctgtgcgcttgtcctcccggtgtgtctcctcggggacggatctgcgccggggagaagtgggcgacggtggaagcggcggcggaggcggcggccggtcctttctagctgggctctgcctgaggtggcgctgctcgggattcctggacccatctcagctgcttgtggagccccagaagagtctagcttcccatgagagcctggcagaggagctgtaattagagatgtccagtgtcctgaagccttaaatgcttgcttcccagagccctgcctgaaagagaagagaacgatgaccaagttacaggaggcagtgacgttcagggacgtggccgtggtcttcagtaaggaggagatggggctgctggacgctgcccagaggaagctgtaccacgatgtgatgctggagaacctcaggaacctcctggcagtgggaggccagagtccaaataagatgaagactgttgatgcaacaggagtgaggtgccttttactggggcagcttctgtactgggaaataacaggccacgatgccaacaaactggccagagctccggaagctgtagtccacactcaaggaaagggttctcacttcctggagcaaggccactcctcctgccacagggaagcagaggagcctcgccggccttctgaggatgacagttctctcgacagtctgacacgtgaccattccagcactactgaaaatcaggaatttctgtctgggagagcccaggggtcttggtgtaaaacacatcttaggaaaagacagaaccatcagaaacactgtctgcagactctgatgaaaaacaagccagagctgttgactcagcattcccctgtacaaagaacacaggaggacagcaggcatagctctagcgtccccattcaacaaagtgttcatccaggaagaaagcgctactggtgtcatgagtgtggcaagggtttcagtcagagctcagctctccagactcaccggagagtgcacacgggggagaagccctgcagggacaacagctgtaggaaaagcttcagtcgtagctctggtcttagcatccaccgccaagtacacactggagagagaccttaccggtgtaaagtgtgtgggaagggtttcttgcggtggtcacacctccaggcccacgagagaattcacacaggagagaagccatataagtgtggagaatgtggtaaacgcttcagctgtatttcaaaccttcacacccaccagagattccacagcaaggagaaaccatacaagtgtgacaagtgtgggaagtgcttcagcttgaacttcaaccttcacattcatcagcgggtccacacaggagagaaaccgtataaatgtgaagagtgtgggaagtgtttcagcttgagcttcaacctccacagccatcagcgggtccacacaggagagaagccatataaatgtgaagagtgtgggaagtgtttcagttcagcctcaagtttccaaagacaccggcagatccatataaaagagaagacacttcatcgtgatgtgtgtggaaagggcagcagccgggactcgaatcttcagactcaccagagagtgcacatacaggagaagccctatcggtgcaacagctgtgggaagagcttccgctgtagcatggatctcaacatccaccgccgagtacatactggagagaaaccttacaagtgtgaggtgtgtgggaagggcttcaattatttgtcacacctccaggcccacgagaaaattcatgcagatcagaagccatataagtgtgaatactgtggcagacgcttcagctatagttcaaaccttcacacccaccagagagttcacacgggagagaaaccctataaatgtgaggagtgtgggaaaagcttcagtctagcgtctagtctacaggctcatcaaagagtccaaactggcaagaagccattcaaatgcaatgcatgccaaaagcgattcagtcaggcctggaacctccaggcccaccagagagtgcacactggggagaagccctacaagtgtgacacgtgtgggaaagccttcggccagaggtccagtcttcaaatccatcagagaattcacactggggagaagccattcaaatgtgaggagtgtgggaaggagttcagcttgaattcagggcttactgctcaccggagggtccacacgggagagaagccctatgaatgcacagagtgtgggaaaggctttagtcttgcctcaagtctacgaactcatcagcgaattcacaccggcgagaaacccttccaatgcaatgagtgccagaagaggttcagtcaggtctcacacctccagtcccaccagagggttcacacaggggagaagccttacaaatgtgacacctgtgggaaggccttcagtcaaaagtctggtctccaagtccatcggagaattcacactggggagaagccgttcaagtgtgaggagtgtgggaaggaattcatctggagctcagggcttagtgctcaccggagggtccacacaggagaaaaaaccctgcacggttagcagtgtgggaagggcttcagtcagacctcacacttccgattaacagtctgatccaatgtaaacacagcaggatcattatatcaaggctgttacaaaataattgaaaacaaagtgtaaggtagctagtatacaatgagaaaaagcagtatgacacatggtgaaattatacaattagtcagatagcatcctggtaggaaatgacacatatagatttatatttaacaattttgcatcccctgtatcccctggatatagaattaaa

SEQ ID NO: 4174 - DNA, 2543 bp, Rattus norvegicus
  Genbank Accession No. NM_133324
cggcggcggcggcggcggaggtagtggtgtcggcgtccttatcttcacggcgcgaacggcataatggttatgaaagccgcagtagatgatgacgcttcgggatgggagctcaatgtccctgagaaaatggaaaaaagtagcacaagctgggtggacataacccaggactttgaagatgcttgtcgagagctgaagttgggagaactgcttcacgataagctgtttggtctgtttgaagccatgtctgctattgaaatgatggatcccaagatggatgccgggatgatcgggaaccaagtgaatagaaaagtcctcaattttgaacaagccgtcaaggatggcaccattaaaattaaagacctcagcttgcctgaactgataggaataatggatacctgtttttgctgtttgatcacatggctcgaaggccattccttggcacagacggtatttacatgcctttacattcataatccagacttcatagaagaccctgccatgaaagcttttgctctgggaatcttgaagatctgtgacattgcaagggaaaaagtcaacaaagctgctgcttttgaggaggaagatttccagtcaatgacatatggatttaaaatggccaacggtgtgacagatcttcgagttacagggatgctcaaagatgtggaggacgacatgcaaaggagagtaaagagtactcgaagtcgacaaggagaagagagagacccagaagttgaactagaacaccagcagtgcttggcagcgttcagcagagtgaagttcacccgagtactgctgacagtgctcatagccttcactaagaaagagaccagtgctgttgcagaggctcagaaactgatggtccaggcggcagaccttctttctgccattcacacctcattgcaccacggcatccaggctcagaatggcactaccaaaggagaccatccaattatgatgggttttgagccccttgttaaccagagattacttccacccaccttccctcgctatgcaaaaataattaaaagagaagaaatggtcaactatttctcaagattaatagacaggataaaaactgtctgtgaagtcgtgaacttaccaaacttacattgtatcctggattttttctgtgaatttagtgaacagtcaccatgtgttctttcaagatctctgttacaaactactttcctcgtggataacaaaaaagtctttgggactcatctcatgcaagacatggtgaaagatgctccccggtccttcgtcagtcctccggtgctctcccccaagtgttgcctgtataataatcaccaggctaaggactgcatcgactcctttgttactcactgtgttcggccattttgtagtcttgttcagatccatggccataacagggctcggcagagagacaaacttggtcacattcttgaagagtttgccaccttgcaagatgaggcagagaaggtcgatgcagcgctccacactatgttgttgaagcaggagcctcagcgacagcatctggcctgtttaggaacttgggttctctaccacagcctgcggattatgatccagtacctgctcagcggctttgatctggagctctacagcatgcacgagtactactacatctactggtacctctctgagttcctgtacgcatggctgatgtcaaccctgagccgtgctgacggctctcagatggcagaagagaggataatggaagaacagcagaaaggccgcagcagcaagaaaacaaagaagaagaagaaagttcgtccattgagccgagagatcacaatgagccaggcctatcagaacatgtgtgctgggatgttcaaaacgatggtcgcatttgacatggatggcaaagtgcgcaagcccaaatttgagcttgacagtgagcaggtccggtatgagcacaggtttgctccgttcaacagcgtgatgacgccaccaccagtgcactacctgcagttcaaggaaatgtctgacctcagtaaatacagccctcctcctcagcctccagagctgtatgtggcagctagtaagcactttcagcaggcaaagatgatccttgagagcatccccaatgcagaccgggaggtcagcaggatcctaaaggttgccaagcctaactttgtggttatgaagctcttagcaggaggacacaagaaagagtcaaaggttcctcctgaatttgatttctctgttcacaaatactttcctgttgtgaaactggtttgaaagagactgcaaagatgaccatgtctactctggggtacaccagtgtgccacacacggtgacataaagtggctctcttgaatgacagcttgttacaggaagacttcagtatcagtacaacacccttacctggagagaacgaaactgctgttttaaagtggtttgttatactccatgggtgtgacgggctggaatgcattggtgaacgttacatggttttattacagacttcattgtaaaacttttttaatgaatgattgtgtgaaatagtgtttgtaaaggttaataaatttcttgacaaaaa

SEQ ID NO: 4175 - DNA, 3576 bp, Rattus norvegicus
  Genbank Accession No. NM_133380
gcgtccgggcggcgtaggaaaccgggcgaggtccttcgcgcaggaaagccccgcacggcgcgtggagcctgaacacacaggtgctggagagggagcccaggatctgggggccaggtacgctgccactgagctgcattccagtctctccctgtatagcccaggcacctttgtgtccgcaatggggtggctttgcaccaagttcctgtcctccgtgagctgtctgattttgctatgggtgactggctctgggggcatcaaggtcctgggtgaccccacctgcttctctgactacatccgcacttctacgtgtgagtggcagctggatagcactgtggactgcagttctcagctcctcctggactacaggctgctctttgagttctctgaaaacctcacatgcacccccaagaacagtgccgacaccgtgtgtgtgtgccaaatggccatagaggagccgatccaggcagacacatactggctggaactgtggtctgagcggggacagctgtggcaaggctccttcaagcctagtgacaatgtgaagcccccagctccagacaacctcacactccacaccaatgtctccaatgcgctgctgctgatgtggagcaacccatacccatcgaacaacttcctgcacaaaggcctcatctgcatggtcaacatctccagagaggacaacccggcggaattcaaagtctataatgtgacctacacggaacccaagctgagcttcccagtcaacaccctaacatcaggggtgcgctatagggcacgtgtgagggtcttgtcccagagcttccctggcatctggagtgagtggagtcccagcatcacgtggtacaacccaaataatgtcaatctgtgactgaatgaccttgggggctccagtggtgaggagagcacacagagcagtggagctgacttccagctgcccctgctgcagcgcctcccgctgggtgtcagcatctcctgcatctgcatcctattgttttgcctgacctgttacttcagcattatcaagattaagaagatatggtgggaccagattcccactccagcacgcagtcccttagcagccatcatcattcaggacacgaaggtgtccctctgggagaagcagacccgaagccaggagtcaaccaagagccggcactggaagacttgtctaaccaagctgctgccctgcttgctggagcatagagtgaagaaagagagagaatccccgaaggctgccaaaaccaagcctctccagagtcctgaaaaagcaggctggtatcctgcggaggtcagcaggaccgtcctctggccagagaacgttcatgtcagtgtggtgcgctgtatggagctgtttgaggccccagtacagaatgtggaggaggaagaggatgagatggtcaaaggggacctgagcatgtcacctgagaacagcggagggggcttccaggagagtcaggcagacatcatggcccggctcactgagaacctgttttcagacttgctgggggctgagaatggaggcgttggccagtcgagcatggcagagtcatcctcccttctgccttcagaaagtgggcaagcttctacgtcctgggcctgcttccccacggggcccagtgagaccacatgccaggtcacagggcagcagcctccacacccagaccctgagagagcaactggcacagcctgcacacaggtcccccttgtcatttcagacaatcctgcctaccggagttttagtgacttctccagccccgccccaaatcctggagagctggcttcagaacagaagcaggctggacatctggaagaaggggatcttctgagcccggttgacccccattcttcagggccaccaatgcagcaagcggagagctgggagcagatccttcacatgagtgtcctgcagcacgggacagctggctccaccccagcccctaccagtggctaccaagagtttgtgcaggcagtgaagcagggtgcgtcccaggacgctggggtgcctggtgtcgggccttctggagacactggttacaaggctttctcgagcctgctcagcagcagtggcgtctgcacggacacagcagcagcagggactgacagtggatgtggagggtacaagcccttccagaaccctgttcctaaccagtcccccaactccatgcccttattcaccttcggactggacatggagctgccacccagtcccctgaactcagccccacccaatagcaccccagaatgccttggtctagagctggggctcaaaggaggcacctggctgaaggcccctcctccttcagagcaggtgcccaagccctttggggatgacctgggccttggcattgtgtactcgtccctcacctgccatctgtgtggccacctgaagcaacaccacagccaggaggaagatggtcagatccatgtcgttgctagccctggctgcggctgttgctatgatgaaaaatcaccatccttggggaatctctcggggaccttggagagctgtcctggggaaatgtcacaggaagccaacctcaccttagcacccaggacaccctccaatttgtcaggggtgggcaagggccctggccactctcctgttcccagccagactactgaggtacctgtgggcactctgggcgtcactgtgtcttaggtgagtgtgctgttgttgctgaggtctgtgctaaggccggggttcctccaagccagggaagtgcttcctgagagacagcccagctggcaggtttcccagaaatcgaaagaatggtgaagtgaagatgtgaacttggcctgaccctagaagttcagagcctggctgtctcccctaccgttggcctgggctctcctccctcacaagggattcagggactcattttgctttctcccacagcagtgctgatattcttaagccctgggctctcctagctcttgttgccctacctgctcaggcccattctgtccacccaatagaccgtttgcccaaggctcacagcagtcctggcatagctgtcgggttctccagctggaagctggtcctagaaactcgcagctggcctggcagtggcttgggaggccctaactagtggaaattttgagttaagggagggtagatactgccccaaggaggctattcattgaacagctcggactgagactagaagcagagcctgctgtcccagcttggcccagttgtggaaagcaacaagaacgcaaacttgattgcccaaagtcactgccagttacccacatgtggccagaagccagggctcccaggatgtggaagtgggatcccagtaaacaaacacagcagcctagtggcaggtcccagtggacaccaccactggcagccaaggcgagaccacaagggaactgtggggctggttctggttggtggccagatgatagggatggcagatggcagactgcagtctgactgcattctggaggacgggaccaggctcaggactgtctgctcgtgtccctacctttgggacacctagtatgtttgcaaggagggcaggacagaagaggtcacgtggagctctatgtcaataaagactctttatcttg

SEQ ID NO: 4176 - DNA, 2046 bp, Rattus norvegicus
  Genbank Accession No. NM_133383
ctgaggcggggttttcatcatggagctgtcgcggcggatttgtctcgtccgactgtggctgttgctactgtcgttcttgctgggcttcagcgcgggatctgccctcaactggcgggaacaagaaggcaaggaagtatgggattacgtgactgttcgagaggatgcacgcatgttctggtggctctactatgccaccaacccttgcaagaacttctcagagctgcctctggtcatgtggcttcagggtggtccaggtggttctagcactggatttggaaactttgaggaaatcggccctcttgacacccgactcaagccacggaacactacctggctgcagtgggccagtctcctgtttgtggacaatcctgtgggcacgggcttcagttacgtgaacacgacagatgcctacgcaaaggacctggacacggtggcttccgacatgatggtcctcctgaaatccttctttgattgtcataaagaattccagacggttccgttctacattttctcagaatcctacggaggaaagatggctgctggcatcagtttagaacttcacaaggctattcagcaagggaccatcaagtgcaacttctctggggttgctttgggtgactcctggatctcccctgtggattcagtgctgtcctggggaccttacctgtacagcgtgtctctccttgataataaaggcttggctgaggtgtccgacattgcggagcaagtcctcaatgctgtaaacaagggcttctacaaggaagccactcagctgtgggggaaagcagaaatgatcattgaaaagaacaccgacggggtaaacttctataacatcttaactaaaagcacccccgacacctctatggagtcgagcctcgagttcttccggagccccttagttcgtctctgtcagcgccacgtgagacacctacaaggagacgccttaagtcagctcatgaacggtcccatcaaaaagaagctcaaaattatccctgacgatgtctcctggggagcccagtcgtcctccgtcttcataagcatggaagaggacttcatgaagcctgtcatcgacatcgtggatacgttgctggaactcggggtcaatgtgactgtgtacaatgggcagctggatctcattgtggacaccataggtcaggagtcctgggttcagaagctgaagtggccacagctgtccagattcaatcagctaaaatggaaggccctgtacaccaatcctaagtcttcagaaacatctgcgtttgtcaagtcctatgagaacttagcgttctactggatcctaaaggcgggtcacatggttcctgctgaccaaggggacatggctctgaagatgatgaggctggttactcagcaggagtagctgagctgagctggccctggaggccctggaggccctggaggccctggagtagggcccaggatgcaggtgctaatgtctatccccggcgctcttcttcccgactctaccatgggatgtaactccaggagcccctgccatctcccgtaccaaaagactgtggcttccgtgtctactcagaaatcagttctacttcgtaaacagtgtttaaaaccagactcatttaatcagagtgaaggattgcagtccattggcttcttagcacagaagcagctgataacacaagtaaaccccagcccttgagaggtagaagcaagaggatcagaggttcaagcgcatcctcggctccatcataagttcaaaagccgcctgcaccaaatgggagtccttgtctcaaaaaaaaaaaaaaaaaaaaaaaagcaaagaaagcaaaggactcgatgacatgatttatagacaaaagcagtgggagaaaatactaaagccccactgagctgccagccaggtgtctgtgactacaggtcttttatctgctacatatatatttttacaaaaatgaaatccatattgttcgctattttgctgtctgctttgctcccgtatcaacatgacttgcacgtcttttcccatcaataaatgtgccatgatatttttaaaaaaaaaaaaaaaaa

SEQ ID NO: 4177 - DNA, 2234 bp, Rattus norvegicus
  Genbank Accession No. NM_133398
agccattgttccgccgggggaggacaagcgaggcctggcgctggcgccccgacgccacttagcggccgcctctggagacactctgtccccgccgccccgtgtcctcctggcggcggcggcgtgaggccgactggagggagtgggaaccctcggccctccccgtggcggcggcggccacctattccccactctggagtgaggggcggccgcgatgcgcttggcctaaggtgtcgcggccctcgtcgcttcccacgactgttccagcggcgtctgtgctccccggcgtcatcccgagagtctctgacgggagggaagatggctgcacgaagctggcaggacgaactggctcagcaggccgaggagggctctgcccggctgcgggagttgctctctgtcggcctaggttttctgcgcacggagttgggcctcgacctggggttggagccgaagcggtacccgagctgggtgatcctggtgggcaccggcgctctcgggttgctgcttctcttcctcctaggttacggctgggccgctgcttgcgccggcgcccgcaaaaagcgaaggagcccgccccgcaagcgggaggaggtgaccccgccgactccggcccccgaggacccagcccaactgaagaatctcagaagcgaggagcaaaagaaaaagaaccggaagaagctgcctgaaaagcccaaaccaaatggacggactgttgaaatacctgaagatgaagttgttagaactccccgaagtataactgccaagcagccaccagagacagacaagaaaaatgaaaagtcaaagaaaaataagaagaagtcaaagtcagatgctaaagcagtgcaaaacagttcacgccatgatggaaaggaagttgatgaaggagcctgggaaactaaaattagtcacagagagaaacgacaacagcgtaaacgtgataaagtgctgactgattctggttcattggattcaactatccctgggatagaaaataccatcacagttaccaccgagcaacttacaactgcatcatttcctgttggttccaagaagaataaaggtgattctcatctaaatgttcaagttagcaactttaagtctggaaaaggagattctacacttcaggtttcttcagggttgaatgaaaatattactgtcaatggaggaggctggagtgaaaagtctgtaaaactctcctcacaattgagtgcaggtgaggagaagtggaactctgtcccacctgcttctgcaggcaagagaaaaacagagcagtctgcttggactcaagaccctggtgatactaatgcaaatgggaaagactggggaaggaattggagtgatcgctcaatattttctggcattggatctactgctgagccagtttctcagtctaccacttctgattatcagtgggatggtagccgtaatcagccccatatcgatgatgaatggtctgggttaaatggtttgtcttctgctgatcctagctcagactggaatgcaccagcagaagagtgggggaactgggtagatgaagatagagcttcacttctgaagtcccaggagccgatttctaatgatcaaaaggattcagatgatgataaggaaaaaggagaaggagctcttccaactggaaaatctaaaaagaaaaaaaagaaaaagaagaagcaaggtgaagataactctatcacccaggacacagaagacctagaaaaggacactagagaagagcttccagtgaatacctcgaaagcccgtccaaaacaggagaaagcttgttccctgaagaccatgagcactagtgatccagttgaagtactcatcaaaaatagccagcctatcaagactcttccacctgctatctctgccgagccatctgttactttatcaaagggtgactctgacaagagctcttcccaagtgccaccgatgttacaagacacagacaaacccaagtcaaatgctaagcaaaacagtgtgcctccctcacagaccaagtctgaaactaattgggaatctccaaaacaaataaaaaagaagaaaaaggccagacgggaaacgtgaatttttttcctaaattggacatgtgtttacaaacactgtcttgaagattatgctgtttatgcaataatttgtgaacatgtacagagttttatataaatttaaaccaatttttaaaacaaaactgaacacaaccaccataaaatggaatcaaagggaaagttaatttatgaaat

SEQ ID NO: 4178 - DNA, 1946 bp, Rattus norvegicus
  Genbank Accession No. NM_133418
ccggggtcgggccaggtcgctgctgctctggccatggctgaggcacgcacgtctcgctggtactttggagggctggcttcctgcggagctgcctgctgcacgcaccctctagacctgctcaaggtgcatttgcagacccaacaggaggtgaagcttcgaatgactggaatggcactgcaggtggtgcgaaccgatggcttcctggcactctacaatggcctgagtgcctcgctgtgcaggcagatgacctactccctgacccggttcgctatctacgagaccatgcgggactacatgaccaaggacagccaggggcctctccccttctacagcaaggtgttgctgggcggcatcagtggtttaactggaggcttcgtggggaccccagcagatttggtcaatgtcaggatgcagaatgacatgaagctgcctctgagccagcgccgcaactactctcacgccctggatggtctgtaccgtgtagcccgtgaagaaggcctgaagaagctcttctctggagcaactatggcatccagccgtggggccctcgtcactgtgggccagctgtcctgctacgaccaggccaagcagctggttctcagtactgggtacctgagtgacaacattttcacccacttcctctccagtttcattgcgggcggatgtgccacatttctctgccagcccctggacgtgctgaagactcgcttgatgaactccaagggcgagtatcagggtgttttccattgtgccgtggagacagcaaagcttggaccacaggcctttttcaagggtctcgttcctgcgggcgtccgtctcgtcccccacaccgtgcttaccttcatgttcctggagcagctgcggaagcacttcggtatcaaagtggcaacctgacaccgccagggacacctgggctgcgctcagtcgctgtgctgagccccttggaagagtaggaagggagtgggctcccttcctccttggcctgggcccgtgctgatccccagaagattcctgttcttcccacccttgggctgctggctacgccttccgaccctgccttggccccactgaagtggcacctctgccctactggctcccaggctctccccactgggacgtcccatcttcctacccgatgattcactcagaagaggtctggcctggctggtgtcactgtccccacctccctggctgctaccctgccctgcctgtcaagcccggagaagctgagtacacttcctgctcttgctggcccactgaacagcttccacccaggacttgggtagtgtggcagggtacagcccctggcagcttctgcttaccaaatgactagagcacgcacgcacacacatacacacatgcacttacgtcacaagagggaccaccgtgcagtgttctggaaggtagtgccttcaggagagggaacagggcagcagcacagatcaccagcaaacgccatgaccgcggagtccggagaaagtacctggggttccctgtgcacctcccgtgctcagccttggctgctttaagagtcagtttttgcggaaccctcctactcagcagccactaccatcatcaggaactggctgtgtccctcatacacctgtgccctcccttgcctggcttcccccagggccaggggctcatgctggagctggggctatgatggattcattttatgtgtcctcctaggacctgttttcccgtatggcaggggtcacccctcaccatccctcagggttcaaagcagcctgttttccctcaaattggggttgtgtgtatatcaacgtgaggttgggccctgtgcccgtttgcctcccctcagcaccaggccctcacccaggaggtgcgggaggtggcagtgggcccaggggcactgcctacatctctcttcaggatctaataaaccaagtggccaaaaaaaaaaaaaaaaaaaaaaaaaaaaa

SEQ ID NO: 4179 - DNA, 1803 bp, Rattus norvegicus
  Genbank Accession No. NM_133419
gtcccggcggcgcgtggtgaccgttggcgtgcgcggttctcggctcgcggcggcggttagcggcggttggccgggttgtctgcctgcgacatggcggacgcggaagccgccatgacgttcccgaagaagcacaagaagaagaaagagcggaagccgctgccggaagctgacgtggctgagatccagcacgcggaagatttcctgatcaaaccggagtccaaggcggctcagttggacacctcccagtggcccctgctgctcaagaactttgacagactgaacgtgcggacgacccactacacgcccatcccgtgcggctccaacccgctgaagagggagatcggggagtacgtcaggaccggcttcatcaacctggacaagccatccaacccctcttcgcacgaggtcgtggcctggatccgccgcatcctgcgcgtggagaagacggggcacagcgggacacttgaccccaaggtcaccgggtgcctcatcgtctgcatcgagcgcgccacgcgcctggtcaagtcacagcagagcgcgggcaaagagtatgtcggggtcgtgcggctgcacaatgctatcgaggggaccgcccagctctccagggccctggagaccctgacaggcgccctgttccagcgtcccccgctcatcgcagcagtgaagcggcagctgcgcgtgcgcacaatctatgagagccgtgttgtcgagtatgaccctgagcgcaggctgggtgtgttctgggtgagctgcgaggctggcacctacatccggacgctgtgcgtgcacctggggctgctgctgggcgtcggggggcagatgcaggagctgcggcgcgtgcgctcgggggtcgtgggcgagcgggaccacatggtgaccatgcacgacgtcctggacgcgcagtatctatacgaccaccaccgggacgagagctacctgcgccgcgtggttttcccactggagaagctgctgacgtcgcacaagcgcctggtgatgaaggacagtgcggtcaacgccatctgctacggcgcgaagatcatgctccccggcctcctgcgctacgaggacggcatcgaggtcaaccaggaggtcgtggtcatcaccaccaagggcgaggccgtctgcgtggccatcgcactgatgacgacggctgtgatctccacgtgcgaccacggggtagtagcgaagatcaagcgcgtcatcatggagcgggacacctacccccgcaagtggggcctggggccgaaggcaagccagaagaagcagctgatcaagcagggcctcctggacaaacatggccgacccacggacggcacccccgcctcctggacgcgcgactacgtggactacagtgactccagcaagaaagcgacggccgccgaagccacgccgggccctggggtcaccgcggacgccgccagcatcgtgaaaaggaaacgcgatagcgacagcgacgccgacgaggcgacgcccactaccacgccccgggtgaagaaggagaagaagaagaaaaaggagaaggcggacggcggggaggaggctgcggaggacggggacggcgacgccacaaggaagaaaaagaagaagaaggcaagggcggcagaggagctcagtggttagcgactacccccgacccccacgcggcgaccatcccgtcctgttttaaggacgcgaggcgtaggaacggggtctccaccactgacccctccactcacttgagcccccgacgaccgcccgcggcgattcgccggaggccatgttgagcgacaccgcagacggccctggcctgccctccattttttt

SEQ ID NO: 4180 - DNA, 2968 bp, Rattus norvegicus
  Genbank Accession No. NM_133423
atggcggccgacagccgggaggagaaagatggggaacttaatgttttagatgatattttgactgaagtaccagaacaggatgatgaactgtataatccagagagtgaacaagataaaaatgagaaaaaaggatcaaaaagaaaaagtgaaagaatggaatctattgacaccaagcgacagaagccttctatccattcaagacaactgatttctaagccactaagctcatctgttagcaataataaaagaatagttagtacaaaaggaaagtcggttacagaatataaaaatgaggaatatcaaagatctgaaaggaacaagcgtctagatgctgatcgaaaaattcgtctgtcaagcagttcctctagagaaccttacaagagtcaaccagaaaaaccttgtctacggaaaagggattctgaaagaagggccaagtctcctacaccagatggttctgagagaattgggcttgaagttgatagacgtgcaagcagatccagccagtcttcaaaggaagaggggaactctgaggagtatggctctgaccacgagacaggaagcagtgcttcttctgaacagggcaacaacactgagaatgaggaggaaggaggggaagaagatgtagaggaagatgaagaggtagatgaagatggagatgatgatgaggaagtggatgaagatgcggaggaggaggaggacgaggaagaagatgaggaggaggaggatgaggaagaagaagaggaagaggaagaagaatatgaacaggatgagagagatcagaaggaagaagggaatgattatgacacccgtagtgaggccagtgattctggttctgagtctgtttccttcacagatggatctgtcaggtctggttcaggaacagatggatcagatgagaaaaagaaggaaaggaagagagctcgaggcatatcacccattgtctttgatagaagtggcagttctgcatcagagtcatatgcaggttcagaaaagaagcatgagaaattatcatcttccgttcgtgctgtccgaaaagatcaaaccagtaaactcaaatctgtccttcaggatgcaagatttttcctcataaagagtaacaaccatgagaatgtgtctcttgccaaagcaaagggtgtatggtccacattacctgtaaatgagaagaaattaaatcttgcgtttagatctgcaaggagtgttatattaatattttctgtcagggaaagtggaaagtttcaaggttttgccagattgtcatcagaatcgcatcatggtggctctcctatacattgggtgcttccagcaggaatgagtgctaaaatgcttggaggtgtttttaaaattgactggatttgcaggcgtgaattaccctttactaagtcagctcatctcaccaatccctggaatgaacataagccagtaaagattggacgtgatggacaggaaattgaacttgaatgtggaacccagctttgtcttctgtttccccctgatgaaagtattgacttgtatcagctcattcataaaatgcgtcacaagagaagaatgcattctcagcctcgatcaagaggacgtccatcccgtcgagaaccagtccgggatgtgggaaggcgtcgaccagaagattatgatattcataacagcagaaagaaaccaaggattgactatccccctgagtttcaccagagaccagggtatttaaaggatccccgataccaggaagttgacagtttcacaaatcttattcccaacagacgattttcaggagttcgccgagatgtgtttttaaatgggtcctacaatgattatgtgagggaatttcataacatgggaccaccgcctccttggcaaggaatgcctccttacccgggaatagaacagcctccacaccatccctactaccagcaccatgccccgcctcctcaagcccaccccccttactcaggacaccatccggtaccacatgaagcaagatacagagataaacgagtacatgactatgatatgagggttgatgatttccttcgccgcacacaagccgttgtcagtggtcggagaagtagaccccgagaaagagatcgggagcgagagcgagaccgccctagagataacagaagagatagagagcgagacagaggtcgtgatcgagaaagagagagagaaagaatatgtgatcgggacagagaccgaggggaaagaggtcgttatcgaagataatgtgctttttggaagcactgactgaagataaaaaatattgtattttttttgtgtgtgtttacaagtagtaaatttattttcagctgtctacttaaagctcattgtgtagaaggatttattatcttctttgttccaagcatgcagtagaataagaactggaaaactcagatccgccaaaaaatgcacagttgacagttgagttgacacttttattggggcagaatggaacagtccaagaatgtagatattgattcattctccataaatgttctttttacagtgtattcatcctagagttattttgtttgtttgttttccttcttttggaccttggtcaatactgccatagtattttgctttgtgtttctataggtagctgcacacggttcagtaaaaataatgctgctatcaagtatgcagatattgagtatgatggtttgactatatggcagtgttgtagcagcctctcggtttctcctcttccctccttttttttaaacctataaatccactttttttttaagtcttcaatgatgagagcaatattaagaagacattgctatctaatttttaatctttttaaataaaacgttcctatgttcagtagcatggtcgatgctattgtttagccttccttccaaactgtacattggcttggaatgttcagttttgcgtgtgtggcagcagaagataaccccacattctacattgctactgttttgtatgaaataaattggtaaagattgacact

SEQ ID NO: 4181 - DNA, 1461 bp, Rattus norvegicus
  Genbank Accession No. NM_133427
atggattggttccgattgaccaaaagtggaaaggacttcacgggattgaagggcgggttaattgaagtaacagaagaagaacttaagaagcacaacaagaaagacgactgttggatatgcataagagggtttgtttacaatgtcagcccatatatggagtatcatcctggtggggaggatgagcttatgagagccgcaggagcagatggaacggatctttttaatgaggtgcatcgttgggtcaattatgaatccatgctgaaagagtgcctggttggcaggatggctgtgaagcccgctgttccgaaagactgtcatgaaggaaagagagtcttaaatggcatgcttcccaagagccaagtgacagacacactgcccagggaaggccccagttctccaagctatgattggttccaaacagagtcttcagtgaccattgttatatacaccaagcagaagaatatcaatttagactcagtaatcgttgacctccaggatgactccttgagagcagaagcagtcatcaaggatcattcttatcttatacatattgggttaagccatgaagttcaagaaaatttttctgtacgggttattgagaatgttggaaaaatagagattgtcctactaaagaaagaaactgtttcttggaaatgtcttggtgatcccctggagaaacatgattcttttattccaaagaaagatacaggcttgtactatagacagtgccagttaatttccaaggaagacgttactcatgacacaaggctcttctgtctgatgctgcctcccagtactcaccttcaggtgccagttgggcaacatgtttacctcaagctcagtgtcacaggtgcagaaatagtaaagccatatacacccgtgtctgagtccttactctcagattttaaagaaccagttctttccccaaataagtacatctactttttgatcaaaatctatcctgctggactcttcacgccagaacttgatcgtcttcagattggagattttgtttctgtaagtggtcctgagggcaattttaaagtttccaaactccaggaagtggaagatctctttttattggcagccggaacaggcttcacaccaatggttactgtactgaatcacgctttaactcacatgtccagtctcaggaaggtgaagttaatgttcttcaataaaacagaggatgacataatttggagatgccagctagagaaattggcattaaaagataaaagatttcatgttgaatatgttctctcggcaccttccccagaatggaatggcaaacagggacacgtgtcacgagctcttctctctgaatttttgcaacgaagtttagaaaattctaaagtcttcctttgcatctgtggaccaaccccatttacagatgaggggataaggttgctgcatgatcttaacttttccgatgatgagattcatggttttacagcataa

SEQ ID NO: 4182 - DNA, 1713 bp, Rattus norvegicus
  Genbank Accession No. NM_133428
tctgtagcattctccactatggtggaccacagccgaggatggttttgcaccatgaaggtgctcaccacggcattgcttctagtcaccctgcagtgttcccatgccctgagtcccaccaactgtgatgcctccaagcctttggctgagaaagttctagacttgatcaataaagggcggaggagtggctatacttttcagctgctgcgggtctctgatgcccacttggacagagtggaaactgccaccatctactacttagttttagatgtggtagaatctgactgttgggtcctctccacaaaagcccaggatgagtgtcttccagccatgaggacatctgaggttgtgattggacagtgtaaggtaatagccacaagatactccaatgagtctcaagatcttagcgtgaatggctataactgcaccatgagatccgtctcttcggcatatatcaacaccaaagacagtcctgtactagtggactcatttgaggattccgagccctacagaaagctagcccgtaaagccctcgacaagtacaaagcggagaatggtgactttgcctcattcagagtggaaagggctgaaagggttataagaatgagaggaggggaaagaaccagctacttcatagaattctcggtgaggaactgttccacacaacacttccccagacaccctccggtctttggattgtgcagagtagttttgacctacagtacagaagcctctgacttggaaaccccagaatacactgacctgatctgtgaagtcttcaacactgaggatcttaaaaacaggagtgacatgaaaccccatcggggccatgagcatcctcattgtgacaaacatctgtgtaagctcagtggacccagggaccatcatcatacccataagacacatgaaattggatgcccaccaccaccagaaggaaaagataactcagacagaccaccccttcaagaaggagcccttccacaaatgctccctggccattctggtccttctggtaccaacaggagccatagaccccctcataatcacagttgtaatgagcatccgtgccatggacagcatccccatggacaccaccctcatggtcagcatccccatggacaccaccctcatggtcagcatccccatggacaccaccctcatggtcagcatccccatggacaccaccctcatggtcagcatccccatggacaccacccccatggtcaccatcctcatggtgaccatccccatggacaccacccccatggacatgatttccttgactatggaccttgtgacccaccctccaatagccaagaactcaagggtcagtatcatcggggacatggtccaccacacggacactcaaggaaaagagggccaggtaaaggactctttcctttccaccaacgacaaatcggatatgtctaccgactccctccactgaatgtaggtgaagttctcactcctcctgaagccaatttccccatcttctctttgccaaattgcaacagacccccacaaccagagattcggcccttccctcagacagcctcaaagtcctgtccagggaaatttgagggtaagtttccacaagtttccaacttttttgaacatacgcctccaaaataaaacctgatttcttggtaggggaaagagtacaatattctgaataaataaaatatgaccagttagaaatgaaaaaaaaaaaaaaaa

SEQ ID NO: 4183 - DNA, 564 bp, Rattus norvegicus
  Genbank Accession No. NM_133525
gcgcgcgcgcaccgcgggcgatggcggcatccggggagcaggctccatgctccgtgtacttctgcgggagcatccgcggcgggcgcgaggaccaagcactgtatgcgcggatcgtgtcgcggctccgacgctatgggaaggtgctcactgagcacgtggctgatgctgagttggagccgcttggggaagaggctgctgggggtgaccagttcatccatgagcaggacctgaactggctgcagcaagcagatgtggtagtggcggaagtgacacagccatccttgggtgttggctatgaactgggccgggcagtagctcttgggaagccaattctgtgcctgtttcgaccacagtctggccgagtgctttccgccatgatccgcggagcagcagatggctcgaggttccaggtatgggactacgcagaaggagaagtggagaccatgctcgatcggtactttgaggcatatcttcctcagaagacggcttcctccagtcacccaagtgcctgaccaccctactgtattaaaaagaaaattaagatttaaaaaaaaaaaaaaaaaa

SEQ ID NO: 4184 - DNA, 2513 bp, Rattus norvegicus
  Genbank Accession No. NM_133528
tggcactatggtcatggcggaggggacggcagtgctgaggcggaacaggccaggcaccaaggcgcaggatttctataattggcctgatgaatcatttgatgaaatggacagtacacttgctgttcagcagtatattcaacagaacataagggcagactgctccaatattgacaaaattcttgaaccacctgaaggtcaagatgaaggtgtatggaagtatgaacatttaaggcaattctgccttgaactaaatggacttgctgtcaaacttcagagtgagtgccatcctgatacttgtactcagatgacagcaactgaacaatggatttttctttgtgcagctcataaaactccaaaagagtgtcctgccatagattatacaagacacacactggatggtgctgcatgtcttctgaatagcaataaatattttcccagcagggttagcataaaagaatcatctgtagcaaaactaggatcagtgtgccgtaggatttacagaatattctcacatgcctattttcatcaccggcagatatttgatgaatatgaaaatgaaacatttttatgtcaccggtttaccaaatttgtgatgaaatataatttgatgtcgaaggataacctgattgtaccaattttagaagaggaagttcagaattcagtttctggggaaagtgaagcatgaaggaatcatgtagaacaatgtactgatcacataattaacaattatgtactgtatatatatcattttagacacatcaatcatgtatccatattatagcttatttgtttagtataggtttttgtatgctatgtgttgcctttttaaatgggaaatacattttaagttattcatgagctgtatattcactggtgtggcactcatggtttttaaataagtttagtattatctgtttataatgcctgttaataaaagaatttacagtttggtataattgctgctaaacaatcattggatcacaatcctctcaaatctataaaggaatgaacttgtgtctcacacaagtatttacaattactaaagagaatattttgttttcacccctaagatttaatattttaggaaattcagtagtattccatctgtactgttaatttttccaaaatgagataaaagtgtttaagagttctgtttatagcttttgatatgcataactgattatgtgtgtgttcagagaaattcgaggaggtgttagtaataaattatctctctcttctacataaagtatcctttaggtcagtgtacatggaagcattacctttgctatggcagtgcattattaaatacatggtgaggaggaggaggcacatacatgatgttcccatggacacccacccgccccttgtttcccttagtcctctgggaagtatactagtcatgaaatttacttaccaagctatggttagtggtggcttttccctatttatactgtattaattgcttacagagcatacctcatactagcagtgacgttacactacagggaaactggactgcctacctttgttttttaaaatggttgtaactacttagaaaatagtccttaatatagtttgacttttcctgttagtaatattaatcttttcacctagccctaggcagcattaaatagatatgaaaaaaaagatagtgtatttattttattctccctccttaaaagcttattgttctaattatatgcacatgtaagactatttacaataattcacaggttaagtgctgttgataagtggtcatactttgatttcttatttcagtgtcttaagaatttaagtgcagacttagataacatgattggtggagtttctctttaaacactgaggtctctatgccacactgtagcaaggcactgagatgaaacagagacctgtgcagttgggacaattgaagccatcttttccaatttaataaacacaagaaacttcttttttatttaagagctatttgcaaatgaaattgaaaaatgcattcatcttgtttgtttttctaattatttgaagaaatgatttgtattgtattataagacaagtatacacagaaaaattgggaagtgagagcaaactgagagtgtgtgtatagttgacgcctgtctgaacctgtgctgtgccagcggtcacagtcatcactgtacctgagcccacagttatcttctgagaagttcatgtatgcagtgaatagaacattgactgaaattgggtgtttatattactgtcaccataaatcattggggttagtaattttaataaacttggtagatatgagagactaacctatactaagttcataaattatacatagcctagtaatgttgctgttctctagttggagtccccggtggagtcctgttgtttgacttgctcagtgagcagttaaggcaggtggagacctgactgagtacttggaacactttgtgaatatatggcttagtgttaacaggaaaataaagtgtggttttctttttatacttactccaaaaaaaaaaaaaaaaaaa

SEQ ID NO: 4185 - DNA, 1001 bp, Rattus norvegicus
  Genbank Accession No. NM_133536
cggggcagagagcgctcaggctgtgcacgcttgaccaggctcccggaccagagctgtcctagcaagagagaaaaggacatttgcctacaatgagacacgaggcgcccatgcagatggcctcggcacaagatgccaggtttggtcagaaagactcttctgaccagaacttcgactacatgttcaagttgctgatcattggcaatagcagcgtgggcaaaacatccttcctgttccgctatgctgatgactccttcacgtctgcctttgtcagcacggtcggcatcgatttcaaagtaaaaactgtcttcaaaaatgaaaagagaatcaagcttcagatttgggacacagcaggccaggaaagatacaggaccatcaccacagcctattatcgaggggccatgggcttcattttaatgtatgacatcacaaatgaagaatccttcaacgctgtacaagattggtcaactcagatcaaaacatattcctgggataatgcccaggttatactggtcggaaacaaatgtgacatggaagacgaacgggtggtctcaactgagagagggcgccacttaggagagcagctcgggtttgagttttttgaaaccagcgccaaggataacatcaacgtgaagcaaacctttgagcgcctcgtagatatcatctgtgacaaaatgtcagagagcttggagactgacccagccatcacaggcgccaagcagagcacgaggctcaaggaaacccctcctccaccacagcccaactgtggctgctaatgtccccccgcacaggagctccaagggcccccagagcagccaagaaaccgcatttataaatggtctattagccttcaatcatactgcctaataattatttgaaggaagtctttgatgtcagtggcccatatatgcattcaaaccgtgagcaatttcctgtggtaatatgtggcgaatttgctcttatatttgtaaggattattcatctataaacacctgctacttgca

SEQ ID NO: 4186 - DNA, 6878 bp, Rattus norvegicus
  Genbank Accession No. NM_133541
gccggggctgctaactgaagaggccatggacgcgctcgagtcgttgttggacgaggtggccctggaggggctcgacggcctgtgcctgcccgcgctgtggagccgcctggaatcccgctcgcctgccttccctttgccgctggaaccctacacgcaggagtttctgtggcgggccttagtcacgcacccgggcatcagtttctacgaggagccgcgagagcgacctgacctgcagctccaagaccgatatgaagaaatcgacttggaaactggaattttggagtccaggagggacccagtcactctggaagatgtctaccccattcatatgatcttagagaataaggatggcatccagggctcctgccgatactttaaggagagaaaggacatcaccagtagcatcaggagcaagtgtttgcagcctcgttgtacaatggtagaagccttcagcaggtggggtaagaagctcatcattgtggcttcccaggacatgcgataccgggccttgataggcctagagggggatcctgatctgaagcttcctgatttctcctactgcattttggagcggttaggtcgatcgagatggcaaggggagctgcaacgagaccttcacaccaccgctttcaaggtcgacgctgggaagcttcattatcacaggaaaattttgaacaagaatgggctcattacaatgcagtcacacgtgatccgactgcctactggagcccagcaacactccatcctcctcctccttaaccggtttcatgtagacaggaggagcaagtacgacatcctcatggagaagctgtctatgatgctgagcacacggagcaaccagatcgagactctgggcaagctgagggaggagctgggactgtgtgaaaggacgttcaagcgtctgtaccagtacatgctgaatgctgggctggccaaagtggtgtcccttcccttgcaggagattcaccctgagtgtggtccctgtaagaccaagaaagggactgatgtcatggttcggtgccttaagctcctgaaggagttcaggcgaaagatggaagacgaccatgacgacgatgacgatgaagaggccatctccaaggctgtacctcccgtggacatcgtgtttgagcgggacatgctcacgcagacctacgagctcattgagcgcagaggaacgaaaggaatttcccaagctgagatccgagttgctatgaatgtgggaaaactggaagcaagaatgctgtgtcggctccttcagaggttcaaggttgtcaagggattcatggaagatgaaggccggcagaggaccaccaagtacatttcctgtgtatttgcggaggagagtgacttgagccgccaatatgcgcgtgaaaaggcccgaggagagctgctaaccactgtgagcctcgcctcagtgcaagatgaatccctcatgcctgagggtgaagaggccttcctctctgactccgaaagtgaggaagagagcagctgcagtggcaagcgtaggggccgagggtcccgggggcattcaagagcctctggggatgctgggcctggctctcggcctcatcactccactccagccaagggcgggtggaaagtcctaaatctgcacccattaaagaagcccaaaagtgccgctgtggaaagatcccgccgaagctctgcttgtagggatggcctggacaccagcagctcatccgagctcaatataccctttgaccctcacagcatggacagtcacagtggtgacatcgctgtgattgaggaggtccggcttgataaccccaaggagggtggtggctcccagaagggcggacggcatggctcaggccaggacaagcctcacaaaacataccgactgctaaagcgcagaaatctgattatagaagctgtcaccaacctccgcctgattgagagcctgttcacgattcagaagatgatcatggaccaggagaagcaagagggtgtctccaccaaatgctgtaagaagtccattatccgcttggtgcggaacctgtctgaggagggtctcttgagattgtataggactacagtcattcaagatggcatcaagaagaaggtagacctggtcgtgcacccttccatggaccagaatgaccctcttgtgagaagtgctattgagcaggttcgcttccggatctccaactcaagcacagcaaacagggttaaagttccaccggccccagcaccccaagaggaagcagaagagggaaaccaagaaccagaggtcccaagtagatcagcagactctgaagcgaacacatcctcgaagccagaaagcacacgggtgaaaaagacagatgagaaaatgggcataaccccactcaagaattacaaacctgtcatagttcctggacttgggcgctccatagggttccttcccaagatgccacgccttcgggtgatgcacctgttcctgtggtacctggtgtatgggcatcctgccagccacactggggaacagcctactttccacagtgagaggaaaacaggcaagcaggagcccagcagaccaggggtccagccctcctcaggagatgactgggactcctctgaagccaaaaacagcacagaaagcagctcctgggaggcagaaatggaactctccacagagagagtgtatgtggatgagatctcatggatgcgctacgtccctcccatccccatccacagagacttcggctttggctgggctcttgtcagtgacattcttctctgccttcccctctccatctttgtccaagttgttcaagtcagctacaaggtggataacctggaggattttctgaatgaccctctgaagaagcacacactgatccgcttcctccctaggcacatccggcagcagctactgtataagaggcggtatattttctcggtggtggagaacctgcaacggctgtgctacatggggctgctacagtttggacccacagagaagtttcaggataaagaccaggtctttgttttcctgaagaagaatgcagtcattgtggacaccaccatctgtgacccacattacaacctggcccacagcagccggccttttgagagacgtctctacgtcttggattccatgcaggatgtggaaagctactggtttgacctgcagtgtatctgcctaaacaccccactaggtgtggtgcgttgtccatgtgcacagaagatctgccctgatccgggcagtgacccagaaggcagcttgcggaaggagcaagagagcgccatggacaagcacaacctagagcgcaagtgtgccatgctggagtataccacggggagccgagaagttgtggatgaaggcttagtccctggggatggactgggagctgctgggctggactctagcttctatgcacacctgaagcgcaactgggtctggaccagctatatcatcaacaaagccagaaagaacaacacctccgaaaatgggctcacaggaagactccagactttcctgtctaagcgcccaatgccacttgggtctggaggcagtggccgtctgcctctctggtcagaggggaaagctgatgctgagctctgtgctgacaaagaggaacactttgaactggaccgagaacctacccctggcaggaaccgaaaagtgcgtgggggcaagagtcagaagcggaagcggctgaagaaggagcccatcaggaagaccaagcgaaggagaagaggagagcatccagaagccaaaagcaaaaaactacgctaccaagatgaggctgaccagaacgccctccggatgatgacccggcttcgggtttcttggtccatgcaggaggatgggttactaatgctctgccgaattgccagcaatgtcctcaacaccaaggtgaaaggaccatttgtcacctggcaggtcgtgcgtgacattttgcatgctacctttgaagagtctttggataaaacatctcactcggttggacgaagagctcgctacatagtcaaaaatccccaggcctttatgaactacaaagtctgcctggcagaagtgtaccaagataaggcactcgttggagatttcatgagtcggaaggataactacgaagacccaaaggtctgtgccaaggagtttaaagaatttgtggagaagctgaaagagaagttcagctctggcctgaggaaccccaaccttgagatcccagacacactgcaggaactctttgccaaataccgggtgttggcaatcggagatgaaaaggaccgtgtcaggaaggaggatgaactgaatagtgtggaggacatccacttcctggtgctacagaacctgatccagagcacactgtccctctctaacagccagtccaactcttgccagtccttccagatcttccgcctctaccgggagttccgggagcctgtgctggtgcgggccttcatggagtgccaaaagaggagcctggtcaaccgacgccgtgtcagccactcccagggtcccaagaagaaccgtgctgtgccctttgtgcccatgtcctaccagctctcccagtcatactacaagcttttcacctggcgatttcccaccaccgtctgcaccgaatccttccagttctatgacagactacgggccaacggcatactagaccagcctgatcatttttctttcaaggacatggatagcaatgacccttcaagtgacctggtggcgttttctttggacagccctggaggacactgtgtgacagccctggccctcttctccttgggcctcctctctgtggatgtccgaatcccagagcagattgtggtggtagacagctccatggtggagagtgaggtcatgaagagcttggggaaagatggcggcttggatgatgatgatgaggaggaagacctggatgaaggttcagggaccaagcgtcagagtgtggaagtaaaggcccatcaggcctcacacaccaagtacctgctgatgagaggttactacacagtgcctggcatggtcagcacgcgcaacctgaaccccaatgacagcattgtggtcaattcctgccaggttaaattccgactgcgcaatacccctgcacccacccatcttgggcccactgggcccacagccacaccgctagaagagctccaggctggcccttcctgcctccctgcctcctttaccagcctggtggatccacagctgcacacccgctgcccagaagagtttgcccaccagatggcacagtctgggtacagccctgaggacgtggctgcgtccctagagatcctgcaggctgtggcagctgctgactgcttcggggttgacagggagaagctgagcagacagttctctgccttggagaagatagcggacaagcgcaccaggacgttcctggactatatccaggacctcttggaacagcaacaagtcatggaagttggaggcaacactgtgcgcctagtggccatggcctctgcccagccctggctcctgccttcagtgcgtctgaaagatgtggaaatagacaccaaggcctcaggggatgacagccaatctagactccctgcggggtcttccatcgaagaccacacctctgagggtgcaccaattcctccagtcagctccaatggcactaaaaagcgcccctactgctctattcagagccctgaaactgatgctgaggaagctacaaggctccctgccaagaagcccacattacaagatgtctgtgtggctgccagtcctaggcctggaacagaagagcagacagaggcccaggctcagtttgcagctcctgaagatgcaggtgcagagggccccaggcaggagagccaagagagtgttggtgtctcaggcctagagcagctgggctgtgagttccagcttccagaaaattctgaagaccccagaggacttacagagagcaacatggcccaggtagcatgggagagcggctgtgaaagagtatgttttgtcggtcgcccatggcgtggtgtggacgggcgcctgaacatgcccgtgtgcaaaggcatgatggaagccgtgctgtaccacatcatgtcaaggcccggtgttcctgagagctgcctgctacagtactaccagggcgtcctacagcctgttgctgtgcttgagctgctccggggcttagagtctctcggctgtatccagaagcggatgctgaagaagccagcgagtgtctcactcttctccaggcctgtggtggagggcctaggtcaggccagtgaggccgaggcactctcctgtcaggggagcactgtcaccttttatgaacctactctggactgtaccatccgtctgggccgtgtcttcccccatgacatcaactggaaacaaagtggatccatttatagatgcgtcccaggccagcagaggagcctctgcccgtgcttaattgttccgcctggactgtcccaagagccccgtccttcacacagctgttaccagagctcggcccagcctagcacaggtgtagcaactagcaggtgacttcagtcccctctgctctcggctgctcttggtcccaggtgcccagccttcctgcagccctgtgtcctgccctggactcaggctctagcatcagcagtatctgcaagggatgttgtttagggagcaggctgatgaccaagccctgagtcacctcacacgcaccacaccattcagactcagaggaagacacatcacaggtgtacctggcagagtctgctcctcttaaggtagggcatcccaacttggcctgaactgagctcaggtctccagctcccaagggcccctcccgccagaagcaaggcctgtaggttttgcttttgtttttgttttattttgcgctcttttcactagatacaagcccctggcatgtatttatttattttttaattaaagtaagatgaaatgc

SEQ ID NO: 4187 - DNA, 2225 bp, Rattus norvegicus
  Genbank Accession No. NM_133546
ctgcagtacttgtacattgctaaataaagagagggactccaggaggagcagcctgggtctaagaggtaggcagaaggaggttttaggggcctgagcacaagcttgaggagagaaaggttattaaaaagccagacgcttacaggtctcagaagggctagccagaaactgtggctggggttaaggaaagggtttaagagtgtgggcttttggttctgaggatgtagaacgtgaatgttgagagaagaaccaagtggcggagttgggtgtgagcaatgctattaggaatttgaggcagggattcacgcgctgctgtgactattttttaacaatgactcagtgctgtgacctgatactgtttccagagcgacttctaaacaaattccccctttctaggccagacacatggccccaagcccaagaccccagcatgtcctgcactggaaggaagcccactctttctacctcctgtctccactgatgggcttcctcagccgggcctggagccgcctgagggggcccgaggtctcagaggcctggttggcagaaacagtagcaggagcaaaccagatagaggctgatgctctgttgacgcctcccccggtctctgaaaatcacctacctctccgagagactgaaggaaatggaactcctgaatggagtaaagcagcccagaggctctgccttgatgtggaagcccaaagttcccctcctaaaacttggggactttcagatattgatgaacataatgggaagccaggacaagatggccttagagagcaagaagtggagcacacagctggcctgcctacactacagccccttcacctgcaaggggcagataagaaagttggggaggtggtggctagagaagagggtgtgtccgagctggcttaccccacatcacactgggagggtggtccagctgaggatgaagaggatacagaaaccgtgaagaaggctcaccaggcctctgctgcttccatagctccaggatataaacccagcacttctgtgtattgcccaggggaggcagaacatcgagccacggaggaaaaaggaacagacaataaggctgaaccctcaggctcccactccagagtctgggagtaccacactagagagaggcctaagcaggagggagaaactaagccagagcaacacagggcagggcagagtcacccttgtcagaatgcagaggctgaggaaggaggacctgagacttctgtctgttctggcagtgccttcctgaaggcctgggtgtatcgcccaggagaggacacagaggaggaagaagacagtgatttggattcagctgaggaagacacagctcatacctgtaccaccccccatacaagtgccttcctgaaggcctgggtctatcgcccaggagaggacacagaagaggaagatgacggtgattgggattcagctgaggaagacgcgtctcagagctgtaccaccccccatacaagtgccttcctgaaggcctgggtctatcgcccaggagaggacacagaagaggaagacgacagtgagaatgtggccccagttgactcagaaacagttgactcttgccagagtacccagcattgtctaccagtagagaagaccaagggatgtggagaagcagagccccctcccttccagtggccttctatttacctggacagaagccagcaccaccttgggctgcccctaagctgccccttcgactgcagaagcggctcagatctttcaaagcccccgcccggaatcagggccctgagattcctctgaagggtagaaaggtgcacttctctgagaaagttacagtccatttccttgctgtctgggcaggaccagcccaggctgctcgtcgaggcccctgggagcagtttgcacgagatcgaagccgctttgctcgacgcattgccaggcagaggagcagctgggtccttaccttacccctgctttcagggccagagcatggacacgccttagaaacctaccccttcctctgtcgtcctcgtctcttccactgcctgagccttgctcttccactgaggccacacccctcagccaagatgtgaccactccctctccccttcccagtgaaatccctcctcccagcctggacttgggaggaaggcgggctaagcctgagtagttttttgtgtattctatgagtgttagtctcttaatacgaatatgtaacgccttttgcatttgtaaaaaaaaaaaaaaaa

SEQ ID NO: 4188 - DNA, 1542 bp, Rattus norvegicus
  Genbank Accession No. NM_133553
ggcgaggggaaccaagctgtccccggggccggctgcggtgggtcgggaccggagtgcatgagactgactgcatctcatgatgctaccgggcccgtgcatggctcaccccgtctctgctgcagcagctggttagggccgctctcgcagctcccagcgctcttaacagctctgcccacaggtctctgcggctcaccatgcccctcagcctcttccggcgcctccttctggcggtcctactactggtgatcatctggacactgtttggaccatcgggtttgggggaggagctgctgagcctgtccctggcgtcccttctgccagccccagcctcgccaggaccacccctggccctgccccgcctcttgattcctaacccccaggcctgtggtggctccggaccccctcctttcttgctcatcctggtgtgtacggccccggagcacctgaaccagagaaacgccattcggggatcttggggcgccattcgcgaggcccgcggtttcagggtgcagacgctcttcctcctgggagaacctatgggacagcagtttgctgacctggcctcagagtcagcagcacagggggatgtcttgcaggcctccttccaggattcctaccgcaacctcaccctcaagaccctcaccggactgaactgggtgaacaaatactgtcctatggcccggtacatcctcaagacagatgatgacgtgtatgtcaatgtcccagagctggtgtcagaactgatacagagaggggggccttcagagcaatggcagaagggcaaagagccacaggaagagacaacagctgtccacaaagagcacaaaggccaggcagtgccccttctgtatttaggccgggtgcactggagggtgaggcccactcgaacaccagagtcccggcatcacgtgtcagaagaactgtggccagaaaactggggtcctttcccaccctacgcctctggcacggggtatgtattgtctatctctgctgtgcagctcattctgaaggtggccagccgggccccatatctacctctggaggatgtctttgtgggagtaagcgcaaggcgagtgggccttgcccccacacactgtgtcaagttggctggtgctacccactacccactggataggtgctgttacgggaagttcctgctgacgtcccacaaggtggatccttggaaaatgcaggaagcctggaagctggtgagaggactgaatgggagaaggactgagcccttttgttcctggctccagggatttctgggtaccttgaggtgccggttcatagcctggctcaatagttgagagcctggggccacagaaaacaagacagcacctcaggaacttttgccccaaaatcagtgcccaggctgcagctccccgtggtgatctatttccccacagcagactctgaagctgctactgaccaaggatagatagggggcttggggcctggcctgccatctccaaagaccagggagggacgaagcacagggtgtggggaagactcaagagcccaataaacacgtctctctac

SEQ ID NO: 4189 - DNA, 1700 bp, Rattus norvegicus
  Genbank Accession No. NM_133554
agtggatggagaccaagtccatcaattagaagataagtctcaaatggagaaccggtgcctccccaagaaagttccaggtttctgttcctttcggtatggactggctatccttttgcacttctgtaacattgtcatcatggctcagcgagtgtgcctgaacctcacaatggtagccatggtgaataaaacagagccaccccatttatctaacaagtctgtagcagagatgctggataatgtaaagaaccctgtgcattcctggagtcttgatattcaagggcttgttctcagttctgtcttcttgggtatggttgtgattcaagttcctgttgggtacctatctggagcatacccaatggagaaaataattgggtcttcattgttcctcagctctgtgctgtccctgctcatcccaccagctgcacaagtcggagcagctttggtcattgtatgccgagtactccaaggaatagcccagggagcagtgtcaacaggccagcatggaatatgggtcaaatgggcacctcccttggaacgaggcagacttacctctatgactctatcagggtttgtaatgggaccatttattgccctgcttgtgagcggcttcatctgtgatcttctgggttggcccatggttttctacatctttggtattgttgggtgtgttctgagtcttttctggttcatccttctctttgatgaccccaacaaccacccatatatgagcagcagtgagaaggattacatcacatcctctctcatgcaacaggtgcactcaggcagacaatctctgccaatcaaagctatgcttaagtctcttccactctgggccattatcctcaatagctttgctttcatatggtcgaacaatcttctggttacatacacgccaacatttattagcaccacgcttcatgttaatgttagagagaatgggctgctgtccagcctcccctatctgcttgcctacatctgtggtatcgtagcaggtcagatgtcagacttcctcctgtcaaggaagattttcagcgtagttgctgtccggaaactcttcaccacactagggattttctgtcctgtgatttttgtcgtgtgcctgctctacctgagctacaacttctacagcaccgtcattttccttacacttgccaactcgacacttagcttttccttctgtggacaacttatcaatgccttggatattgctcccagatattatggatttctaaaggcagtcacagctttaattggaatatttgggggcctaatttcttcaactcttgctgggttgatccttaatcaggatccggaatatgcttggcataaaaacttcttcttgatggcaggcattaacgtgacatgcctggctttctaccttctgtttgcaaaaggagatattcaggactgggctaaagaaacaaaaaccacacggctgtgaagttagtagaagagtgagcacctgagaaacatgaggtcagcatccatattgaaaggaagaggattctgtgtgggactgcagtcatgggagtcatgaacacctgaagaccggtagcctgaagcttttaagggagtcattgcctcccactttagtctgagtgattcttttgcactgtgtattgtgtgtaacaagttatacttctgactttaaagaggaatctgtctgtcttcctatgatccaataaacaaacgtattcggg

SEQ ID NO: 4190 - DNA, 901 bp, Rattus norvegicus
  Genbank Accession No. NM_133561
gctggccgggtcgaccctggtgtcatccgtttaggaagcggcttcaccgccaacagcacggccatggctggagctctggtgcgcaaagcagcggactatgtccggagcaaggacttccgggactatctcatgagtacgcacttctggggcccagttgccaactggggtctccccattgctgctatcaatgacatgaagaaatctccagagattatcagtgggcggatgactttcgccctctgttgctattctctgacattcatgagatttgcctacaaggtacaaccccgaaactggcttctgtttgcgtgccatgtgacaaacgaagtcgctcagctcattcagggaggacgacttatcaactacgagatgagtaagcggccatctgcctagcagtgcaaggaccagctcttgaaagggacagtgctccagccactgttgcggccacagatcacgtcagcatgaatagtcgtgctgaggggaaaacacggaagactatctttaatgaccatgccaacattattgaatagccaagaatccccaaaccaactctcggctgccttatcaatgctaaactttatttgtcttcatcaggagtagttcaaaatatgcagctaatttaataattttgaatgatgttatctatagcaatctgtagtaatatgtatattatctattgggatttgtgtaataaaaaatctaagggaacaaaactttataactacaagcacttaagtcctcaaaattcttgactttttctttaatgactatagtataaccctcagttggtcacatgtctacacataatttccagtgataacaagtagcggtgttttccatatgtaattcagatctgaacttaatggcaataaatggtttaaatatttgcgaaaaaaaaaaa

SEQ ID NO: 4191 - DNA, 1281 bp, Rattus norvegicus
  Genbank Accession No. NM_133567
ggccgcgcagccatggccggggagcggcgccgggcgctgctggagctgctgacgcgtccggggaactcgcgctgcgctgactgcggagccccggatcctgactgggcgtcctacaccctgggtgtgttcatctgtttgagctgctctgggatccaccggaacatcccccaggtcagcaaggtgaagtcagttcgtctggatgcctgggatgagacccaagttgagttcatgacatctcatgggaacgaggctgccagagccacatttgagtccaaagtaccacccttctactaccggcccacgttctccgactgccaactcctacgtgagcagtggatccgtgccaagtatgagaggcaagaattccttcatgtggagaaacaggaaccgtactctacaggataccgtgagggccttctctggaagcgtggccgggacaacggacagttcttaagtcggaagtttgtgctgacagaacgagagggtgctctgaaatacttcaacaaaaatgacgctaaggagcctaaggctgtcatgaagattgagcacctgaatgccaccttccagccagccaagatcggccacccccatggcctgcaggtcacctacttgaaggacaacagcactcgcaacatctttatctaccacgaggatggcaaggagatcgtggactggttcaatgcgctgcgagcagcccgcttccactacctgcaggtggctttcccaggagccagtgacgcagatctggtgcccaagctctctaggaactacctgaaggaaggctacatggagaagacagggcccaagcagacagaaggctttcggaagcgctggttcaccatggacgaccggaggctcatgtacttcaaagaccctctggatgcctttgcccgaggggaagtcttcattggcagcaaggaaagtggttacacggtcctggagggcctcccaccgtcaacccagagtcaccactggccccatggcatcaccattgtcacccctgaccgaaaattcctgttcacgtgtgagacagagtcagaccagagggagtggatagcagccttccagaaggtggtggacaggcccatgctgcctcaggagtacgcagtggaagcccacttcaagcataaaccctaaggaagagagcccggaggccccaggattctgcactcgtgtggcggcgctggacagcaggagagcctctgttcctcggtgtggcccaggcatggccaggtggggctcaggcaagcccatcagatagacagatttttcagaacctca

SEQ ID NO: 4192 - DNA, 1269 bp, Rattus norvegicus
  Genbank Accession No. NM_133570
ttggaagcagtaagtctgccagaggggccagtgcttaatccagcaagccttagctctatacagccagagcgcaccctcctcctgcgttatcctgcatctggcagaacaagcgaggctgctgctgctgcttggggattgccaggggcaaaggggggttcgtgatacctcgttggagaagacgtctaggatggtagaaagtagtccgatgggactaggagagaaagggcgctgggtcaaggtacactcagcctttcatcactcgctgtagatggatggtttcccggccaggcatctggagcacggctcgctatagggagacgtcagtgtgctcaggtccggggtggaagagcccccggcccctcccgcgcaggcttgctttatataaagtccggggccgcgtggagtcgaagcggcagtggcagagctcctgagaactgtcctcctgtcactgctctgtcgggacaacgcactctcagcctagtggagcgctctgagggcttccctccaggaccatgcgcggctccgagctctcgctcttgctgttggctctggtcctctgccaggctccccgggggccagctgccccggtgtcgacaggcgcaggtggaggcacagtcctggccaagatgtatccgcgcggcagccactgggctgtaggacacttaatggggaagaagagcacagatgagttgccgcccctgtatgcagctgacagagatggcctgaaggagcaactgaggggatacatccgctgggaagaagctgcaaggaatttgcttggcctcctcgaagcctcgaggaacagaagccaccagccacctcaggatcagcctctgggcagtctccagcctacttgggatccagaggatggcagctacttcagtgatgctcaaaatgctaagttggtagactctctgctccaggttctcaaggggaaggaaggaactgccagctgaagggaccatgacaagggcggcttccaaggagcaaaacaaaaccccccagagactgccttctgcaaacattgattctactggaccatcaacaagattccctttgtgcaatttacgtaactattctcatgtcactcaactgcaactaaactcgtgatttttgagcagcatcttctggtttgaacctgtttctgtgaacaactacctaggaagagctttccagtgaacgctttttccagctaggcttttttgctgattggatttggggctcaatctgctaccattcacaataaaaagcttcagtaatcacactgtc

SEQ ID NO: 4193 - DNA, 1998 bp, Rattus norvegicus
  Genbank Accession No. NM_133583
acgcggggccccaaccccctgcttgttgtccaacttctcacggagcagcgggagagcaagcggcaggactcggctgaggaggccaccatggcagagcttcaggaggtgcagatcactgaggagaagccactgttgccaggacagacgcctgaggctgccaagactcattctgtggagacaccttatggctccgtcacttttaccgtgtatggcacccccaaacccaaacgtccagcgatattcacctaccatgatgtaggactcaactataaatcttgcttccagccactgtttcagttcggggatatgcaagagatcatacagaacttcgtgcgggtccatgtggatgcccctggaatggaagagggggcacctgtgtttcctctggggtaccagtacccatctcaggaccagcttgcagacatgattccttgcatcctgcagtacttaaatttctctacgataattggagttggcgttggagctggagcatacattctgtcacgatacgctctgaaccacccggacaccgttgaaggtcttgttctcatcaacattgatcccaacgccaagggctggatggattgggcagcccacaagttaaccggccttacgtcttccattccggagatgattcttgggcaccttttcagccaggaagagctttctggaaattctgaattgatacagaagtatagaagtctcatcacacacgcgcccaacctggagaacatcgaactgtattggaacagttacaacaaccgccgagacctgaactttgagcgaggtggtgagatgaccctcaagtgccccgtgatgctggtggtaggagaccaagcacctcatgaagatgccgtggtggaatgtaattcaaaactggaccccacacagacctcattcctcaagatggcggactctggaggtcagccgcagctgactcagccaggcaagctgacagaagctttcaagtacttcgtgcaaggcatgggctacatggcctcatcctgtatgactcgcctgtctcggtctcgcacagcatctctgaccagtgcggcatccatcgatggcagtcggtcccgatcccgcaccctgtcgcagagtagcgagtctgggactctcccttctggacccccggggcacaccatggaagtctcctgttgagcgaccctctttgccttggtgtggaacccagccctcacctcccgcagcactaacttaagaggtgttttcagggcaatgggccagagtcagcaaggaaaatgggcagattgtgcagggagatgatgaccttgatctttaattgctaccctaaccttgacctttaacctgtgatatcctctagctcctcggtgaggtgtcctaatatctcttagagatccaggccccctaagtcatctcctcctcccgttttggtcttgagaaggcttttatgttccctctctgacctgggttctatagatgaggaacaataagttgttttagctgtcacggggatgccatcactccccctctttagcccatatttgcaagggtaggagagtgtgtgtatgtgtagggttggtggtgggatatgaggagctccattcccccaaagctgaaacagtgccttgacgtttaaggcctctgaaggcaatgctcctaaatggatgtctctcaggggaatatttgctggtgtgttactgatccttaacgtgatagacatatccagcatgtaaaaagaaagtcagaacgggagatggtggccagtgaagaacaatggtaaacacattgaagcaggggcattagggaggggcccgggtcctttggccgcactaactttaatagctgtcagtgtgcacctaaagtgggactgggggaaagaacttaggtccgactgcttggggtttggcatcagggtgggaagggctacctcagactctgaccatactcttgtgtgtagggtgtgacctcctgtctcacacaacttctgctgtgacaataaaagatagaggaaactga

SEQ ID NO: 4194 - DNA, 3397 bp, Rattus norvegicus
  Genbank Accession No. NM_133584
gcagacttgagagtggagcggagggacgagagggtggagcggagtgcgtggcgggcgggtcccccgaagctcgaggagtcgccgcgaagcccgcgcgcgcgcttgcctccggcgcgccgatctgggctgaactaacaagctctgctttggagaaggggctggagccccgccaccggcgccttggggcaacggccgtcgagcagctggtgctggccgcccgagccgggaggtcgactctcgccgggcggggatggtggacgagccggcggggactcgcccgcgcgcggccgccacagggcccggcgctgcccgccagggggcgacgccacgcggggtccgcagccggcgacccgcagcgaagaggcggcgggggccataagggagccggtcgggcacccacggaactccgcgggcccccagagtctccccagtccaccatccgaggagttcggaaacgagcgccccacctctgctatgttgccctttggagacaaaacgagagacatggtcaatgcatggttttcagagagagttcacaacattcctgtgtgcaaggaaggcatccgggcccacaccgagtcctgctcttgctctctgcctcaaagtcctcatgcagataataccacccctggagcaccagccagaaaaatctctgcctctgaatttgaccgacctcttagacccattgttgtcaaggattctgagggaaccgtgagctttctctctgactcaggaaaaaaggaacagatgccactaacctctccaagatttgatagtgatgaaggggaccagtgctcaagactcttggaactagtaaaagatatttccagtcatttggatgtcacagccttgtgtcacaaaattttcttgcatatccatggacttatctctgctgatcgctattccctgttccttgtctgtgaggacagctctaaagacaaatttctcgtcagtcgcctctttgatgttgctgaaggttcaacactggaggaagcttcaaataactgtatccgtttagaatggaacaaaggcattgtgggacatgtggcagcttttggagagcccttgaacatcaaagatgcctatgaggatccccggttcaatgcagaagttgaccaaattacaggctacaagacacaaagtatcctttgtatgccaattaagaaccacagggaagaggtcgttggtgtagctcaggccatcaacaagaaatcaggaaacggtgggacattcactgaaaaagatgaaaaggactttgctgcctatctggcattttgtggcattgttcttcacaacgcccagctctatgaaacgtcactgctggagaacaaaagaaatcaggtattacttgaccttgctagcttaattttcgaggagcagcagtcattggaagtaattctgaagaaaatagccgccactattatctccttcatgcaggtgcagaagtgcaccatcttcatcgtggatgaagactgccctgactcgttctctcgtgtgtttcaaatggagtgggaggaagtagggaaatcctccgagcctttgacaagggagcacgatgcaaacaaaatcaattacatgtatgctcagtatgtcaaaaacacgatggagccacttaatatcccagatgtcaccaaggacaacagatttccctggacaaatgaaaacatgggccatataaacacgcactgcatcagaagtttgctttgcacgcctataaaaaatgggaagaagaacaaagtcataggggtttgccaacttgttaataagatggaggagaagactggcaagattaaggctttcaaccaaaacgatgaacaattcctggaggcttttgtcatcttctgtggcttggggatccagaacacacagatgtacgaagcggtggagagagccatggccaagcagatggtgacgttagaggtcctgtcttatcacgcatcagcggcggaggaagaaacaagggagctccaggctctagcggctgctgtggtaccgtctgcccaaacccttaaaattaccgacttcagcttcagtgacttcgagctgtctgatctggaaacagcgctgtgtacaattcggatgttcactgacctcaaccttgtgcagaacttccagatgaaacacgaggttctttgccgatggattttgagtgtcaagaagaattatcggaagaacgttgcctaccacaattggaggcacgcctttaacacggcacagtgcatgtttgctgctctgaaagcaggcaagattcagaacaagttgacggatctggagacgcttgcattgctgattgccgctttaagccatgatttggaccatcgtggtgtgaacaactcatacatacagcggagcgagcaccccctggcccagctgtactgccactccaccatggagcaccatcacttcgaccagtgcttgatggttctaaacagcccaggcaaccagatcctcagtggcctctccattgaagaatataagaccacattgaaaataatcaagcaagcaattttagccactgacctagcactgtacattaagagacgaggagaattttttgaacttataagaaaaaatgaattcagttttgaagatcctcttcaaaaggagttgtttctggcaatgctgatgactgcctgtgatctctccgccattactaagccctggcctattcaacaacggatagcagaactcgtggcagccgaattctttgatcaaggagacagagagagaaaagaacttaacatggagcccgctgatctaatgaacagggagaagaaaaataaaatcccaagtatgcaagttgggttcatagacgccatctgcttgcagctgtatgaggccctgacccacgtctcagaagactgtttgcccctgctggatggctgcaggaagaacaggcagaaatggcaagccctcgcagaccagcaggagaagacgctccttaatggggagagcggccaggccaagcgggactgaccttctccccctcctcccctcccccacccccaccgggtgttcgaactgccctaggcctggtttcgccatacactatgcagactcgagtgcactttgccactgctgtattttatttttgcacaacttctgagagcatgaggtgtttcagagattgctacctactttccgtgcttttgttttatgccactgaagtggagccgtcagtcatgcccactctaacactttgataagagtggtgtaaactgcattcccacacgcagcttggttatgcttggggagtatgaataaccggcctttgtgtttctgagtcaccagtctttcaaacacgttaggaatcgttctcggaagtgggttaggggcgaactgaatgtgtcctgggacatttaaagccatcctgaaattaacgctgagtggatgttag

SEQ ID NO: 4195 - DNA, 1902 bp, Rattus norvegicus
  Genbank Accession No. NM_133586
tagcccgacgaactgagaactggccatggcacggaaacaaccacatagctggctgaatgctgtgctctttgggctcctgcttattcttatccatgtgtggggtcaggactcaccagagtccagctccatcaggaccacacacacgggccaggtccgaggaaagcttgaccacgtgagggacactaaagctggtgtccacaccttcctgggaattccctttgccaaggctcctgtaggaccgctgcgctttgcacctcctgaggaccctgagccatggagtggtgtgagagatgggacctcacatccggccatgtgtctgcaaaatattgatatgctggatgaagtaggcctgacagatatgaaaatgatactgtcttccattcctatgtctgaggactgcctgtatctcaacatctatacaccagcccatgcccatgagggctctaacctgcctgtgatggtgtgcatccacggaggtgcactggttataggaatggcttccatgtgtgatggatctctattggcagtcaatgaggacttggtggttgtcgctatccagtatcgtctgggtgtcctgggctttttcagcactggagatgagcatgccagaggcaactggggatacctggaccaagtggctgccctgcgatgggtccagcagaatatcgcccattttggaggcaaccctaaccgggtcactatttttggcgtgtctgcaggtggcacaagtgtgtcttcacatgttatatcccccatgtctcaagggctcttccatggtgccatcatggagagtggagtggccctgctgcctgaccttatctctgaaacctctgagacggtctccactacagtggccaagctctctggatgtgaggccacggactcagagaccctggtgcgctgcctgagagccaagagtggagcagagattctggtcattaacaaggtcttcaagatgattcccgctgtggtggatggagagttcctacccaggcatcccaaagagctgttggcatctgaggattttcgccctgtccccagcatcattggtgttaacactgatgagtactgttgcaccattcctatggtcatgggcactgctcaaataataaaggagctatccagagagaacctgcaggctgttctaaaggatacagcagcacaaatgatgcttcctcctgagtgtggtgacctgctaatggaagagtacatggggaatactgatgatccccagaccctacaaatacagtacgctgagatgatgggagacttcctgtttgtgatccctgcactccaagttgcacactttcaacgttcccatgcccctgtctacttctatgagttccaacatgcacccagctatttcaagaatgtcaggccaccccacgtgaaggctgaccatgctgatgaggttccttttgtctttgggtccttcttctggggcataaaagttgacttcactgaggaggagaagctgctgagtaggcggatgatgaagtactgggccaattttgcaagacacgggaaccccaacagcgagggtctaccctactggcctgtgttggaccacgacgagcagtacctgcagttggacacccagcctgctgtggaccgagccctgaaggccagaaggctgcagttctggaccaagactctgccccagaagatccaggagctaaatggagctcagaaaaaccatgcagagctgtagtgtctggtgaaaggaacagagtgtgggagtgagggcaggtgggatcattctgagtttcaaagtctaattttctgttccaacacgcagaatcctttccaaccccaatattttccctttctgacatgaatgagaagccctccgtgtgttactctttattcttctgggcaaaatttaattggactcaataaaga

SEQ ID NO: 4196 - DNA, 1251 bp, Rattus norvegicus
  Genbank Accession No. NM_133590
attttgtgtatgtggtcggaggaagggcccaggtcctctgtacctctccaagcaaggtgctggccacggttcaactctggcgagctgctcggaagtccctgacaagaaggtgccaaccgcggggggtcgagctcgtacccgccccacccaggctgcggccgcgcggggaggaagcgcacccaggccgagtgcaaaagtttccttttctgctttccagttagagaagcttcaaccaaccgagggtggggatgtctgacttcaactggaagagaacccgggagccaaaggggttaaaataagcgaattaccgggaaaacaaacaaaaaactccccaccactagccatgggcagccgagatcacctgtttaaagtgctggtggtgggggacgccgcggtgggtaagacgtcactggtccagcgctactcccaggacagcttcagcaagcactacaagtctaccgtgggagtggattttgctctgaaggttctccagtggtccgactcagaaatggtgcggctccagctgtgggatattgcagggcaggagcgtttcacatccatgacacgactctactaccgagatgcttctgcctgtgtcatcatgtttgacgtcaccaatgccactactttcagcaacagccaacgatggaaacaggatctggatagcaagctcacactgcccagtggggagccagtgccctgcttgctcttggccaacaagagtgatctgtccccttgggcagtgagccgggaccagattgaccggttcagcaaagagaacggttttacgggctggacagaaacatcagtcaaggagaacaaaaatatcaatgaggccatgagagtcctcgtggaaaagatgatgaacaattccagagaagatataatgtcttcgtccacccaagggaactacatcaatctccagaccaaaccctccccaggctggacatgctgctagctcgccttcctctccaggtctctcagccgttccatctcctcctgttggctgctcacctggcctaaaaattctgttgaaagtatttgacctgtctcttgccaactgcctagaaaggaacaccactgtgacttgggaatggctgcctggaacccagatgcatttgttgttccccgatgttgtctgtgacttgctgacagcccgtgtactctagtcagtgtttcctgtgtgacaatgatcacctcattcttccactgtcagatgagtttctgggaaggaataaaaattagcacttg

SEQ ID NO: 4197 - DNA, 1934 bp, Rattus norvegicus
  Genbank Accession No. NM_133591
cgaagcagatgtgactcctgccctgggctgtgctccccatcatggctgacaccatcttcagcagtggaaatgatcagtgggtgtgccccaacgatcggcagcttgctctgagagccaagctgcagacaggctggtctgtgcacacataccagacggagaagcagaggaggactcaatgcctgagccctggagaggtggaggtcatccttcaggtcatccagagagcagagcggctggacatcctggagcagcagaggattgggcggctggtggagcggctggagacgatgcagaagaacgtgatgggcaatggtgtctcccagtgtctgctctgcggggagatgttgggattcctgggcagctcctctgtattctgcaaagactgccggaagaaagtctgcaccaagtgtgggatcgaggcttcccccggccagaagcggcccctgtggctgtgtaagatctgcagtgagcagagagaggtctggaagaggtcaggggcctggttctacaaagggctccccaagtacatcttgcccctgaaaacccctggccgggctgatgatccccacttccgacctctgcctgtggagcccacagaaccacagcctcagagtgctgaagtcagccgtgtctacacatgggcccgagggagagtggtttctagtgacagtgacagtgactcagatctcagctcctccagcctggaggacagacctatgccctctgggatcaagggcacaaaatatgacaagcctagaggggactcaggtggcagcatggagtcacccaggatggggcctgcccgaccgcccagccatctttctggcagccagagcagcctgggcagtgagacgggggcaggtgctacagatccacagggaggcaccctaccccggcctgagcccagggtatccggcaaaaggcatacctgggcaactacccattactgaggtggccggctgacctccctgggctgaggcacactctctggaggaagattcagagagagacaacagggccggcctaccggagcccctctctgaaggttcttgagggctcacaagctccctgataccttgacctgcaactcaacaagccagtgtttggggaccgagcgtgcttgcccccaccctgtagtgccttctctactatctcactcagcaccccaccttttatttattgcccctcccccatcccagtcacatctcgatttgctcgggccttgggttgggttggaaaggccttcctctatgcactgaagtttgggtgggacacacagggctttctttgtactaatgatgcgcactctaaccctcagtgtgaccctgcggagctgagcaaccccaccccacacccccacaccccccaccccccaccacattcccagtgtaagcctggagcaccaggctgtccctattcctccaaccggcgggcggcggggcggcggcggaggccagagcaaggtcctatttgccccgaggctggtccaggagctgagttaaatccagctttgaggtttccccgaagcccctattggcctctgggtttttgttctaccctgaaacacagctccccctcagacattaaaatgctttttgttcttcagtggaaaacaaagctcccaccctgcctcatgctcgctggcccagcctgggagtttcaaattctaaagccagagcaagcgtgaaaaatattcaaaatacagatgcttctggaaaacccctccctggggtgggggtgaggaagtgtcctatgcccttccttccctgagtccagttccatccttccccaccaccatccctcccattattattattaataatggccaccaccattattagccttttgcctgttgctgctggcagaagacaaacttcactatttccctgagatgtgtagccatcagcactaacataataaacataagaattttc

SEQ ID NO: 4198 - DNA, 2146 bp, Rattus norvegicus
  Genbank Accession No. NM_133593
cggacccggcaccgaatcactgactcgcccaggtgtcgggaaaatgatccacagtctatttctcatcaactgttctggcgacatatttctagaaaaacactggaagagcgttgtaagccaatctgtgtgtgactatttctttgaagctcaggagaaagctgctgatgttgaaaatgtaccaactgtcatttcaacacctcaccactacctcattagtatctaccgggataagctcttctttgtgtctgtgatacagactgaagtgccacctctctttgtaattgagtttctgcatcgagttgctgacacttttcaggactactttggtgagtgttcagaggctgcaattaaggataatgtggtcatagtgtatgagctcttggaagaaatgttagacaatggattcccactggctaccgaatctaacattctgaaagaactgattaaaccaccaacaattctacgttctgtcgtcaattctattacaggcagtagtaatgttggggacacgctccccactgggcagctgtccaacatcccatggcgtcgagcaggtgtaaagtacaccaacaatgaagcctactttgatgtagtcgaagagatagatgcgattatagataaatcaggatctacagtctttgcagaaattcaaggtgtcattgatgcttgcattaagctgtctggaatgcctgatctctctctctctttcatgaacccaaggcttctagatgatgtcagcttccacccatgcatccggttcaaacgctgggaatctgagagagttttgtcattcattcctcccgatggaaatttccgactcatatcataccgcgtcagctcacaaaatctagtggcaatcccagtgtatgtgaaacataatatcagctttaaggaaaacagctcttgtggtagatttgatataacaattggaccaaaacagaatatgggaaaaacgattgaaggaatcacagtgactgttcacatgccaaaagttgtgctgaatatgaacctgacaccaacacaaggcagctatacattcgatccagtcaccaaggtactagcatgggatgtggggaaaattactccacaaaagctcccaagtcttaaaggactggtaaatttacagtcaggagcacccaagccagaagagaacccaaacctcaacatacagttcaagatccagcagcttgctatttcaggcttaaaagtgaaccgcttggacatgtatggtgagaagtataagccatttaaaggagtcaagtatatcacaaaggccggaaagttccaagtgaggacatgagaagaggccagacttgctcaagatcagtttgttttgcaagtgtcattgcggtttcttactattaggtaccaagtgggtgggaataatatagagcatctgggtcaagctaccctgctaacaaagttgcttagtaatgatgtaggctcctcaggagctttaagctaaggaaagttttctaaagacttagcttattttgtatcttttcacttaggaaaaggtttaggtgatttttttccatgggggccaccagctgaatgctgcccatgggtaacagtcaaggcagaaggctacagtgataacctctctcctaaagcaagtgaactggtctcatcttccagcaggaactgtctcagtctatgaggtgtcagctgtagccaagggtcacaccttctgatcttagccatctcaatcagtgtctgtcccaagagaggagattgcccccacccccaagaagtttacagaaaactgcctcttcaagtgtttgccttactcagcttttcacttgtgccattaagcaagcactgtagcaaaagccacttccacatggcccaggcagggagccctgcagctccatgctccattcctcacctggttaaccttgggtattatattttttataaataagatttttatgtaaagctcagattttgatttacaagaccttgctgcagtaaatattccatcaatcttgagccaccagttcagctgttagatagcacagtcaaatcatttgcatcaaaagggcaaatactttattaagataatgaaagggaacactacttctgctgttaggcacaagtgtctgtgcttttaaacaaattcaagtagtaaaagagaaaatcaagc

SEQ ID NO: 4199 - DNA, 676 bp, Rattus norvegicus
  Genbank Accession No. NM_133595
ggcgccgcccgcggacagagcagggagtaacggggactgtggtcgcgggcagccccagccactcaccatgccctacctgctcatcagcactcagatccgtatggaagtgggtcccaccatggtgggtgatgagcactcggatccagagctgatgcagcagttgggggcctccaagagacgagtcctgggaaacaacttttatgaatactacgtcaatgaccctcctcgaatagtcctggacaagctggaatgcaggggcttccgagtgttaagcatgacaggggtgggccagacgctggtgtggtgtctgcacaaggaatgacctgcttgagctgacttgtgcgtagggtatatattctttggagggatcgccatgtgccctgtccataatcttgcatcactgtctcccctgtcgctctctttccaaattgtcaacttccttgcccaacactgatgggctgtgaacagcctcaggaaccttgctgcggttggttgggtacagcaggccctgccccggctccttcagcttcccccagctggacctggacctgcctcttgctgtaggccatgtgcagaaggcaagctaccctgaggatggtccctggatcctacacagctaatccaagccaataaagggctctcacaagtgttgttcctcaaaaaaaaaaaaaaaaaa

SEQ ID NO: 4200 - DNA, 3097 bp, Rattus norvegicus
  Genbank Accession No. NM_133606
ggtgcaggataccttgagaaaatggctgagtatctgaggctgccccactccctggcgatgatccgcctctgcaacccgccagtcaacgccgtcagtccaactgtaatcagggaagtaagaaatggactccagaaagctggatcagaccacacggttaaagccattgtgatctgtggcgcaaacggaaacttctgtgcaggtgctgatatccatggctttagtgcttttacccctggccttgcattaggaagcttggtagatgaaatacagagataccagaagccggtgttggccgctatccaaggtgtggctctcggaggaggactggagctggccttgggctgtcactatcggattgccaatgcaaaggctcgtgtcggcttgccagaagtcacactggggattcttcctggtgcaagaggaacccagcttctccccagggtcgttggagttcctgttgctcttgacctaattacctcaggaaaatatctttcagcagatgaagcactcaggcttggaattctggatgcagtcgtgaagtcagacccagttgaagaagccatcaaatttgctcagaagattatagataaacccatagaaccccgcaggatctttaacaagccagttccaagcttgcccaacatggacagtgtttttgcagaagccatcgccaaggtacgaaaacagtaccctggtgtcctggctccggagacgtgtgtccgctcaatccaggcctctgtgaagcatccctacgaagtaggcatcaaggaagaggaaaagctgtttatgtacctccgggcatccgggcaggctaaagccctacagtatgccttctttgctgaaaagtctgcaaataagtggtcaactccctcaggagcgtcttggaaaacagcctctgctcaacccgtctcctcagttggcgttcttggcttgggaacgatgggccgaggcatcgccatttcttttgcgagagtggggatctctgtggttgctgtggagtcagacccaaagcagctagatgctgcaaagaagataatcactttcaccttggagaaggaagcatccagagcgcatcagaacggccaagcttcggcaaaaccaaaactcaggttctcctcatccacaaaggaactttcaactgtggatttggtggttgaagcagtgttcgaagacatgaacctgaagaaaaaggtctttgctgagctgtcagccctgtgcaagccaggagcctttctgtgcaccaatacctcggcgctgaacgtggacgacattgcttcttccacagatcgccctcagctggtgattggcacccacttcttctcaccagcccatgtcatgaggttgctagaggtcattcctagccgatactcttcccctactaccatcgccacggttatgagcttgtccaaaaagatcggaaagattggagtagtggttggcaactgctatggatttgttgggaatcggatgttggctccctattacaaccaggggtttttcttgttagaggaaggtagcaagccagaggatgtagacggggtcttggaagagtttggttttaaaatgggacccttcagagtgtcagacctcgcagggctagatgtgggttggaaaattcgcaaggggcaaggccttactggaccatcattgccaccagggacccccgtccgaaagaggggcaacagcaggtactccccacttggcgatatgctctgtgaagctgggcggtttggtcagaagacaggtaaaggctggtatcagtatgacaagccactgggtcgcatccacaaacctgatccctggctttctacgttcctgtcacaatatagagaggttcaccacatcgagcagcgcaccatcagcaaggaggagatcctggagcgttgcttatattccctcatcaatgaggcgttccgcatcttggaggaggggatggctgctcgcccagagcacattgatgtcatctacttgcacgggtacgggtggccaaggcacaagggcgggcccatgttctatgctgcctcagttgggttgcccacagttctagagaaactgcagaaatattacaggcagaaccctgacatcccccagctggagcccagtgactacctcagaaggctggtagcccagggaagccctcctctgaaggaatggcaaagcttggcagggccccacggcagcaaactgtgattcagccttctgcgttttgccacgtatgttggcacctaatttcagtatgattccttcctaaaatccaaacagatcgctctgaagtacaaatcatgattgctgctgctgctgctgctgatagctggtcagtaaaagctcctctccgtatctttctacctcataattccaatggtcagacttcaggaatgtctacagttagtctatacctctgactgcacttctatcggaaaaattcaacgaatgtatgtttactactacaagcattcttctcttttgactgtttgcccactctaacaaaaacgtatacaaaatgttgctaatagaataattcacacctccagttgacaacccaaatggccttagcagatcaacacaggtggcatatacacgcacttgacacattccagctgtgtgaagttactgccacctgttgtaacatggtgctgggttagagcactgttctgagtgaggggaggcaggcagagaaggcaggcagataaggccacacatcatatggatgtggatataaaattccaggatatgcaggtctgtggacaacatagatgagtagcccaaggctgtaactgttcatacatgcatatattttttggtccttttttttttcggagctggggaccgaacccagggccttgcgcttcctaggtaagcgctctaaccactgagctaaatccccagccccgaggctgtaactgttagaggttaaaaatcactactgattagtacagagtatctttgggagctgataaaattttctaaaattactctagtggtggatctgtaacacattgagttcaatggttcaaagtgaattatattttatatatatatatatatatatatatatatacatatatatatagtctatctcaataaagttaataaaatt

SEQ ID NO: 4201 - DNA, 1470 bp, Rattus norvegicus
  Genbank Accession No. NM_133609
gcggctacggcgtgcggggagctgaggtaaagccggggctagtacggtaccaggcggtgcacgagctggctaagccagatttgtaaaaatggagtttcaagccgtagttatggccgtcggtgggggatctcggatgacagacttgacttccagcattcccaagcctctgcttccagttggaaacaaacctttaatttggtacccgctgaacctgcttgagcgagttggatttgaagaagtcatcgtggttacaaccaaagatgtccaaaaggctctgtgtgcagagttcaagatgaaattgaagccagatattgtgtgcattcctgatgaggcagacatggggactgcagattctctacgccacatatatccaaaacttaagactgatgtgctggtcctgggctgcgatctgataacagatgttgccttacacgaggttgtggacctgttcagagcttacgatgcatcacttgccatgttaatgaggaaaggacaagagagcacagaaccagttccaggtcagaaggggaaaaaaaaaacagtggagcagcgtgacttcattggagtggacagcacaggaaaaaggctgctctttatggctaatgaagcagacttggatgaagagctggtcattaagggatccatcctgcagaagcaccctaggatacatttccagacaggccttgtggatgctcatctctactgcttgaagaaatatgttgtggatttcttaatggaaaataagtcaatcacttctatccgaagcgaactgattccgtacctagtaagaaaacagttttcctcagcctcctcacagcaaaggcaggaagacaaagaagaggatctaaagaaaaaggagcccaagtctttagatatttacagttttataaaaaaagacaacactctgactttggctccctatgatgcctgctggaatgcttttcgaagagacaagtgggaagatttgtctagatcacaggttcgctgctatgtccacatcatgaaggaaggactttgctctcgagtaagcacactgggactctacatggaagccaacagacaggtacccaaattgctgtctgttctttgtcctgaggaatcaatgatccatccatcagcccagattgccaacaaacacctgattggagccgacagccttatcgggtcagatacacaagttggagagaagtcatctattaagcgatctgtcattggctcatcctgtgtcatcagagacagagtaactgttaccaactgccttctcatgaactctgtcaccgtgggagaagggagcagcatccatggcagcgtcatcttcaacaacgccgtggtcgaggcgggcgcggagatcagggactgtttaattggaagtggtcagaggattgaagccaaagctaaacgcatgaacgaggtgatcgtgggaaatgaccagctcatggagatctgaatcctgaacaagtctgaccccac

SEQ ID NO: 4202 - DNA, 3507 bp, Rattus norvegicus
  Genbank Accession No. NM_133610
tggttccccagccccgtgtgcggcaccgccacagtctgggcagcggcggccgggggagcgctactaccatgaactgcttggtcctccttcccagagctgctcatccgggtcggactggagacacactcaggggaccccgccgccgccgccgcgcccccttttctttcggctccatctccactacctcttcctcttcttcttccaccttttcttcctgcttccccccctcccccgccgcggatcctggccgctgctttccagacccaggatgccggggggcaagagagggctggtggctccgcagaacacatttttggagaacatcgtcaggcgctccagtgaatcaagtttcttactgggaaatgcccaaattgtggactggcctgtagtttatagtaatgacggattttgtaaactctctggatatcatcgagctgacgtcatgcagaaaagcagcacttgcagttttatgtatggagaactgaccgataagaagaccattgagaaagtcaggcagacttttgacaactacgagtcaaactgttttgaagttcttctgtataaaaaaaaccgtacccccgtttggttttacatgcaaatcgcaccaataagaaacgaacacgagaaggtggtcttgttcctgtgtacgttcaaggatatcacgctgttcaaacagcccatagaggatgactcaacaaaaggttggacgaaatttgcccggttgacacgggctttgacaaacagccggagtgtgttacagcagcttacaccaatgaataaaacagagacagtccacaaacattcaagactggcagaagttcttcagctgggatcagacatccttcctcagtacaaacaagaagcgccaaagacgccgccgcacatcatcttacattactgtgctttcaaaactacgtgggattgggtgattttaattcttaccttctacaccgccatcatggttccttacaacgtttccttcaaaacaaaacagaacaatatcgcctggctggttctggacagcgtggtggacgttatttttctggtggacatcgttttaaactttcacacgacttttgtggggccgggtggagaggtcatttctgacccaaaactcatacggatgaactatctgaaaacttggtttgtgattgatctgctgtcttgtttaccttatgacatcatcaatgcctttgaaaatgtggatgagggaatcagcagtctcttcagctctttaaaggtggtacgcctcttacgcctgggccgtgttgctaggaaactggaccattacctggaatatggagcagcggtccttgtgctcctggtatgtgtgtttggactggttgcccactggctggcctgcatctggtacagcattggagactatgaggtcattgatgaagtcaccaacaccattcaaatagacagctggctctaccagttggccttgagcattgggactccatatcgctacaataccagtgcagggatctgggaaggaggacccagcaaggactccctgtatgtgtcctccctctacttcaccatgacgagccttacaaccataggatttggaaacatagctccgaccacagacgtggagaagatgttctcagtggccatgatgatggtcggctctcttctttatgcaactatttttggaaatgttaccacaattttccagcaaatgtatgccaacaccaaccgttaccatgagatgctgaacaatgttcgagatttcctgaaattatatcaggtcccgaaaggccttagtgaacgagtcatggattacattgtgtcaacgtggtcaatgtcaaaaggcatcgacacagagaaggtcctctccatctgccccaaggacatgagagctgacatctgtgttcatctgaaccggaaggtttttaatgaacatcctgcattccgattggccagcgatggatgtctgcgtgccttggcagtggagttccaaaccattcactgtgctcctggggacctgatttaccatgctggagagagtgtggacgccctctgctttgtggtgtcagggtccttggaggttatccaggatgaggaggtggtggctatcttagggaaaggtgatgtgtttggagacatcttctggaaggaaaccacccttgctcatgcatgtgccaatgtccgggccctgacttactgtgacctgcacatcatcaagagagaagccttgctcaaagtccttgacttctatacagcatttgcaaactcattctccaggaacctcactctcacttgcaatctaaggaagcggatcatcttccgtaaaattagtgatgtgaaaaaggaggaggaggagcggcttcgacagaagaatgaggtgactctgagcatccccgtggaccacccagtgaggaagctcttccagaagttcaaacagcagaaggagctgaggaaccagggctcagcgcagagcgaccctgagaggagccagcttcaggtagagagccgccctttgcagaatggagcctccatcacaggtaccagtgtggtcactgtgtcacagattacccccatccagacatcgctggcctatgtgaaaaccagcgagactcttaagcagaacaaccgtgatgccatggaactgaagcccaatggtggtgctgagcccaaatgtctcaaggtcaacagccccatcagaatgaaaaacggaaatgggaaggggtggctgagactgaagaacaacatgggggctcacgaggagaaaaaggaagagtggaataatgtcaccaaagctgagtccatggggctgttgtcagaggaccccaagggcagtgactcagagaacagtgtgaccaagaaccccttaaggaaaacggattcttgtgacagtgggattacaaaaagtgaccttcgtttggataaagctggtgaggcccgaagtcctctagaacacagtcccagccaggctgatgccaagcatcccttctaccccatccccgagcaggccttacaaaccacactgcaggaggtaaaacatgaactcaaagaggacatccagctgctgagctgcagaatgactgccctggaaaagcaggtggcagagattttaaaactactctcagagaaaagtgtaccccagacatcttctccaaaaccccaaattccactccaagtacctccccaaataccatgtcaggatatttttagtgtctcaaggcctgagtcacctgaatctgacaaagatgaaatcaacttttaatatatatacatatatatacatatatatttattaatatatttaaaacagtatatacatctatatacataagtgtgtatatatagtatatacatatatattttcacttgctttcattatgatgaacacaatatggattttgatatgtacatactgcatgtccagctggattctggcctgccaaagacaattattcaaaacatagatattgcttgtacattatgcagttgactgcatgcacactttacatttatttatactctctattctgtaat

SEQ ID NO: 4203 - DNA, 1511 bp, Rattus norvegicus
  Genbank Accession No. NM_133617
gatgaagggaagtggcccctggcctccacagctgaccacatgagggtggtttctagcctctttcttcctgtgctccttgcagaggtgtggctggtgagcagtttcaatctcagctcccatacaccagaggctcccattcgcctggtgtctcaggattacgagaatcaaacttgggaagagtacgaatgggctgatcccagggatgataatgaatactggctaagggccagccagcaactctccaatgagacttcaagctttgggttcagcctgcttcgaaagatctccatgaggcacgatggcaatgtgatcttctcaccatttggcctgtctgtggctatggtgaacttgatgctgggggccaagggagagaccaaagtgcaggtagaaaatgggctcaacctacaggccctgagccaggcaggacccctgatccttccagccctcttcaagagagtcaaagagaccttttccagcaacaagaaattgggcctcacccagggtagctttgccttcatccacaaggactttgaaattaaaaagacctatttcaatctatccacaatgtattttgatacagagtacgtgcctacaaattttcgaaattcttcacaagccagagggctcatgaaccattacattaacaaagagactgaggggaaaatccccaagctttttgatgagattaatcctgaaacaaagttaattctggtggactacatcttgttcaaaggcaagtggctgactccatttgaccccatcttcactgaggctgacactttccacctggacaaatacaaggcagttaaggtgcccatgatgtaccgggaagggaactttgcctctacctttgataagaagttccgttgtcacatcctcaaactgccctaccaaggaaatgccaccatgctagtggtccttatggagaaatcgggtgaccacttggccctggaggactacttgaccacagacctcgtggagatgtggctccaggatatgaaaaccagaaaaatggaggtcttctttcccaagttcaagctgaaccagaggtatgagatgcatgagctgctcaagcaggtgggaattaggaggatcttctccacctcagctgacctcagcgaactctcagccgtggcacgaaatcttcaggtgtccaaggtcgtacaacagtcagtgcttgaggtggatgaaaggggaactgaggtggtgtcagggacggtgtcagagatcaccgcttactgcatgcctcctgtcatcaaagtggaccggccttttcacttcatcatctacgaggagatgtcccggatgctcctatttcttggcagggtggtgaacccgacagttctgtgactcgggcatgtaggacctcggccaccacaggtgctgagccagaggtgtctgaatcacaagacgctgttggtagacggtaaaggatgcattctctgtacccagccagtttgctatggctgttgtctgattaacactgaaattaaaatgactcatactttaaa

SEQ ID NO: 4204 - DNA, 1928 bp, Rattus norvegicus
  Genbank Accession No. NM_133618
cagtccagactctaagatttcagaatgactaccatcttgacttccacttttagaaacctttctactacatcaaaatgggccctcagattttctgtaagacctctgagctgttcttcacaagtacagtctgccccagctgtccagaccaagtcaaagaagactttagcaaaacctaatctaaagaacattgtggtggtggaaggtgtccgaattccatttctgctgtcaggcacttcgtataaagacctaatgccacatgatttggctagagccgcactttcgggtttgttgtatcggaccaatattccaaaggatgttgttgattatatcatttttggtacagttattcaggaagtaaaaacaagcaatgtggctagagaggctgccctgggagctggcttctctgataagactccagctcacactgtcaccatggcttgtatctcttcaaaccaagccatgaccacagctgttggtctgatagcttctggccagtgtgatgtcgtcgtggctggtggtgttgagttaatgtctgacgtccctattcgtcattcaagaaatatgaggaaaatgatgcttgatctcaataaagccaagactctggcccagcgcctgtccttactcactaaattcagattgaattttctgtcccctgagctccctgcagtggctgagttctccactaacgagacaatgggccactctgccgaccgtctggctgctgcctttgctgtttctcgaatggaacaggataaatatgcactgcgttctcacagtctggccaagaaggcacaggatgaaggacatctttctgatattgtacccttcaaagtaccaggaaaagacacagttagcaaagataacgggatccgtccttcctcactggagcaaatggccaaactaaagcctgcattcatcaaaccctatggcacagtgacagcagcgaattcttctttcctgactgatggcgcttctgcgatgctaatcatgtcagaggacagagctctggccatgggttataagccaaaggcatatttgagggattttatatatgtgtctcaggatccaaaagatcagcttttacttggaccaacatatgctactccaaaagttctagaaaaggcaggattaaccatgaatgatattgacgcttttgaatttcatgaagccttctcaggtcagattttggctaactttaaagctatggattctgattggtttgcacaaaactacatgggtaggaaaaccaaggttggagcacctcctctggagaagtttaatatctggggcggatcactctctctgggacacccttttggagccactggctgtcggttggtcatggcagctgccaacagactgaggaaggatggaggccagtatgctttagtggctgcctgtgcagctggaggacagggtcatgctatgattgtggaagcctacccaaaatgactgctctggaaggaggcaactgatctctgcagcactcgcactgggcaatgccatttcaatgcactaccaagtgatacctgcagttcctagctcttcttaggaaacaacatttgtggccttctcttaaatattttgcggtcaagccttgccagtgttcgagctttccgataatcacagcttctgctctctaagttccagactatcacagatgtgtacacagttcttgttatctcttgtctctaagactaatgactgccagctgcttggagagaggttagctgaggtttagaaccatctttgtaacatttgcagaatctcctccttcctgtcagtgtcctacagagaattattttttctaaaatacaatccaatgtgcctacattaagttactatagaaaaaaataatctaaacatctcctaaaactgacttgcttagagacatgtttgttgaccttaataaagtagacatgtattag

SEQ ID NO: 4205 - DNA, 987 bp, Rattus norvegicus
  Genbank Accession No. NM_133621
atcagcgctcgcccagtcttcatacgctcacggaccatgtcggcgcagactggcagcggccccacggaggaccaggtggagatcctggagtacaacttcaacaaggtcaacaagcaccccgaccccaccacgctgtgcctcatcgcagccgaggcgggcctcacggaggagcagacgcagaaatggtttaagcagcgcctggcggagtggcggcggtcagaaggcctgccttcggaatgcagatcggtcacggactagggagccaggcccttgagcttgctcccggaacttccgtgcctcagtttacccaggctgttttgatgtttcagtgcagtgttgaatgtctcattgtttgctgcctgctgtttaacacaatgtgttttttgaatgtatataactaaagaaacaaaataacaggaagctaaatgcagttctgtgtaaagcgatggcttggccgggagaggggtgtggcttacgtttctctttggattttaatgaaagatgatgtgggagcagtttttgtttgcccttgaccgccactttccaatccgtatgtaccaccatccgtttcagagcattccagagctgcctggcttctgttgagaagttaaaggaacgggcaggcaggggagacacctcagtccaccttcctgtgcctctttcctcgcttcacttaacactctggtggttggatgagaacacgggtgtatttgagtcattcaatttttatatatttgaaatatagatatataaaacagttccttctcttacagctgcgttaccttggaaaacaccctcgtttagcagcgacagattccaaggggcagaaaagcaggtagctagggaaaaaaagttacagagtctagaatctaccttatttaaatgaacttgttacatttattttgctgaataacatgaaccgcttttttttgtctcaaaaattatattctaaataaaaaactttgagaatccaaaaaaaaaaaaaaa

SEQ ID NO: 4206 - DNA, 1956 bp, Rattus norvegicus
  Genbank Accession No. NM_134326
atgaagtgggtaacctttctcctcctcctcttcatctccggttctgccttttctaggggtgtgtttcgccgagaagcacacaagagtgagatcgcccatcggtttaaggacttaggagaacagcatttcaaaggcctagtcctgattgccttttcccagtatctccagaaatgcccatatgaagagcatatcaaattggtgcaggaagtaacagactttgcaaaaacatgtgtcgctgatgagaatgccgaaaactgtgacaagtccattcacactctcttcggagacaagttatgcgccattccaaagcttcgtgacaactacggtgaactggctgactgctgtgcaaaacaagagcccgaaagaaacgagtgtttcctgcagcacaaggatgacaaccccaacctgccacccttccagaggccggaggctgaggccatgtgcacctccttccaggagaaccctaccagctttctgggacactatttgcatgaagttgccaggagacatccttatttctatgccccagaactcctttactatgctgagaaatacaatgaggttctgacccagtgctgcacagagtctgacaaagcagcctgcctgacaccgaagcttgatgccgtgaaagagaaagcactggtcgcagctgtccgtcagaggatgaagtgctccagtatgcagagatttggagagagagccttcaaagcctgggcagtagctcgtatgagccagagattccccaatgctgagttcgcagaaatcaccaaattggcaacagacgttaccaaaatcaacaaggagtgctgtcacggcgacctgttggaatgcgcggatgacagggcagaacttgccaagtacatgtgtgagaaccaggccactatctccagcaaactgcaggcttgctgtgataagccagtgctgcagaaatcccagtgtctcgctgagacagaacatgacaacattcctgccgatctgccctcaatagctgctgactttgttgaggataaggaagtgtgtaagaactatgctgaggccaaggatgtcttcctgggcacgtttttgtatgaatattcaagaaggcaccccgattactccgtgtccctgctgctgagacttgctaagaaatatgaagccacactggagaagtgctgtgctgaaggcgatcctcctgcctgctacggcacagtgcttgcagaatttcagcctcttgtagaagaacctaagaacttggtcaaaactaactgtgagctttacgagaagcttggagagtatggattccaaaacgccgttctggttcgatacacccagaaagcacctcaggtgtcgaccccaactctcgtggaggcagcaagaaacctgggaagagtgggcaccaagtgttgtacccttcctgaagctcagagactgccctgtgtggaagactatctgtctgccatcctgaaccgtctgtgtgtgctgcatgagaagaccccagtgagcgagaaggtcaccaagtgctgtagtgggtccttggtggaaagacggccatgtttctctgctctgacagttgacgagacatatgtccccaaagagtttaaagctgagaccttcaccttccactctgatatctgcacactcccagacaaggagaagcagataaagaagcaaacggctctcgctgagctggtgaaacacaagcccaaggccacagaagatcagctgaagacggtgatgggtgacttcgcacaattcgtggacaagtgttgcaaggctgccgacaaggataactgcttcgccactgaggggccaaaccttgttgctagaagcaaagaagccttagcctaaacacatcacaaccatctcaggctaccctgagaaaaaaagacatgaagactcaggactcatctcttctgttggtgtaaaaccaacaccctaaggaacacaaatttctttgaacatttgacttcttttctc

SEQ ID NO: 4207 - DNA, 1934 bp, Rattus norvegicus
  Genbank Accession No. NM_134334
cctataagccggcgacctctggcattaagctttgctctcttcgggccgtcgcgaccatgcagacccccggcgtcttgctgctcattctcggcctcctggatgcgtcctcctccgcgcttatcagaatccccctgcgcaagttcacatccatccgtcggactatgacggaagtgggaggctctgtggaagacctgatccttaaaggtcccataaccaagtactccatgcagtcatctcctaggaccaaggagccagtgtcagagttactaaaaaactacctggatgcccagtactatggtgagatcggcattgggactcccccacagtgtttcacagtcgtctttgacactggctcctctaacctgtgggtcccctccattcattgcaagctgctggacatagcctgctgggtccaccacaagtacaacagtgacaagtccagcacctatgtgaagaatggcacatccttcgacatccactacggctcaggtagcctctctgggtacctgagccaggacactgtgtcggttccatgtaagtcagacttaggaggtatcaaggtggagaaacagatctttggggaagccaccaagcagcctggagtcgtattcatcgcagccaagtttgatggcatcttgggcatgggctacccttttatctctgttaacaaggtgctcccggtcttcgacaacctgatgaaacagaagctggtggaaaagaacatcttctccttctacctgaacagggacccaaccgggcaacctggaggagaactaatgcttggcggcactgactccagatactaccacggggagctgtcctacctgaacgtcacccgaaaggcctactggcaggtgcacatggaccagctggaggtgggcagcgagctgaccctgtgcaagggaggctgtgaggctattgtggacacagggacgtctcttctggtggggcctgtggacgaggtgaaggaactacagaaggccattggggcagtgcctctcatccagggcgagtatatgatcccttgtgagaaggtgtccagcctgcccattatcacctttaagctaggaggccaaaactatgaactacacccagagaagtacatactcaaggtatcgcaggctggaaagacgatctgcctgagtggcttcatggggatggacataccccctcccagtgggccgctctggatcctgggcgatgtctttattggctgctactacaccgtgtttgacagagaatacaatagggtcggctttgccaaggctgccacactctaacttgctccttcttcactgtcagggaactggatcagagtccagtagagaaagccagccagccccatccctccacctgccccactcacacatattcacactcgcctagtgttgctgggcccttgggaggcctggctggagctggtccagctgttctgttctgtggtccctgtccctgggttcagattgctgccctccgcctgtctgaaggaggccaaggcctacccagtacaaaaggctgcctttaaaggcccctactggcttggtagctgccgggatgaattgtcttgtcctgctgccctttgctgcgtgggcagcactctgaagcaggcaaatgggtcttgggatccctcccagaaacctgctctgaccagaccctcaggcagcctggggatggcaccaagctctactgccccactatctctggcctggcaaaggctgaaggtgagcagaaggagcaagaggacagaagcaaaactatatgaacctggggggggttacctgggacctgaccccaccctcctgggaaggcatgcttcagcctggggcagaggtaggatggctgactggttttggctggcctctgctgccctcatcctgggctagtcagatgggagccaaagttgatatacaaataaagttgttttgggcctcttt

SEQ ID NO: 4208 - DNA, 1874 bp, Rattus norvegicus
  Genbank Accession No. NM_134346
gccggccgccccgaagactgccggcgacggcgacggggtactgacagcgcgagaggtactaagtgtaacaagtgtgcatcatgcgtgaatataagctagtcgttcttggctcaggaggtgttgggaagtcggctctgactgtacagtttgttcaaggaatttttgttgaaaaatatgatcctacgatagaagattcttatagaaagcaagttgaagtagatgcacagcagtgtatgcttgaaatcctggatgctgcaggaacggagcagtttacagccatgagagatctgtacatgaagaacgaacaaggctttgcgttggtttactccatcacaacgcaaatcgactgtaatgacttacaaggtctgagagagcagattcttcgggttaaagacactgacgatgtcccaatgattctggttggtaacaaatgcgacctggaagacgaaagagttgtccccaaggaacaaggtcagaacctggcaagacagtggagcaactgcgctttcttagagtcctccgccaagtccaagataaatgttaacgagatcttttatgacctagtgcggcaaattaacagaaaaaccccagtgcctgggaaccgtcgcaaaaagtcaccatgtcagctgctttaatgtactgaatgcattgtagctctgagccaggtctgaagaactgttgcccaattcagcagtgccagcattccaactttgttaaacctaccaacatcttaaatggactttcccgtggtggtaccctgtaagaggcggacgaaagctactctatcagtttgcacattctaatcactttccagtatcacgagaggtttgacttatatgatagttctagagtatcgagctggtaaaaccagaggctacatccagtattactgctaagagacattcttcatccaccaatgttgtacatgtatgaaaatggtgtactgtatactttaacacacccatactttgtattggagagtacaataatgtaaatcctaaaagcaccactattttagcataataaaagaaagtccaaagagctcctatatagactactccagataactttgcttctttgatacttgtagcttactgtaattttttttaaattcaaggtcattatcattgtattatacaaaataagcgctttgattaacacagctatatagtttttttaatttttcaaaaacctgtggagacagtgatcttgtctttaaaatatgatagtcctttcagtataatgtcttagattaaagacgttgcctttaatatctgttgggaaggaaatgtccagactttcaaatctccttattattatgtttccttttatcgtttacatagggaacaatgtttatagttgtgtgtacagtgggggtctacaacaagaagtgtatattttcaaacagttttttaatgatttaacaactttgtaaatcattttcaggcttctgcagctgtagattctcactgtgcctcccttgcttgctcgtgcacacgtgtgtctgcaataccaaatacacaggtttagtatcttcgcctgttagtgactgtttccatgtgtaacgttttggttgagatgttaaatggtgacgagtactgtgatgtgaatgtggttgtaatttaatcatgtgtaattggtcacaaggctaatctgcagtaactcttgctgttctatttaacaatgccttgttgccgtttgtatcgattaacgtttgggtgtaaacattgtgtgtccatccaacagggagccacagtatttaaattgaccaacctgatgttgaggtggccaaatgtaaactaaaagccttaattaaagaggagcaattttgtataacttagcatccgtgttcaataaatttggattgccgtgca

SEQ ID NO: 4209 - DNA, 2443 bp, Rattus norvegicus
  Genbank Accession No. NM_134350
gatggttcttagcacagaggaaaacaggagtgttgatttagtcaacttacccagtgtcccactgcccgatggagaggctggcgtaggggagaacaacaaggattccgtgaacaacctctgcagtcagtatgaggagaaggtgcggccctgcattgacctcatcgactccctgcgagctctgggtgtggagcaagacctggccctgcctgccatcgctgtcatcggggaccagagttcagggaagagctctgtgctggaagcactgtctggagtggccctccccagaggcagtggtattgtcaccagatgtcccctggtgctgaaattgaagaagctgaatcagggagaggagtggaaaggcaaagtcacctatgatgacatcgaagtggagctctctgatccttcagaggtggaagaggccatcaacacaggtcagaaccatattgctggggtagggctggggatcagtgataaactcattagcctggatgtcagctccccacacgtcccagacctgactctgattgaccttcctggaatcaccagggtggctgtaggcaaccagccttcagacataggacggcagatcaagagacttatcactaactacatccaaaaacaagagaccatcaacctggtggtggtccccagcaatgtggacattgccaccacagaggccctgagcatggctcaggaggtggaccctgatggggataggaccatcgggatcttgaccaagcctgatctggtggacagagggactgaagacaaggtcgtggatgtggtgaggaacctcgtgtgccacctgaagaagggctacatgatagtcaagtgcaggggtcagcaggacatccaggagcagctgagcctggctgaggctcttcagaaggagcaagtcttcttcaaggaacaccctcaattcagagctcttctggaggatgggaaggccacagtgccctgcctggcagagaggctgaccatggagctcatctcacacatctgtaaatctcttcctttgttagaaaatcaaataaaggaaagtcaccagagtacaagtgaggagctgcagaagtatggtgcagacataccagaagatgagaatgaaaaaactctcttcctgattgaaaaaatcaatgcttttaaccaggacatcactgccatagtagaaggggaagagattgtgagggagaaagaatgtcgcctattcaccaagctccgtaaagagttcttcttgtggagtgaggagatcgaaaggaatttccaaaaaggttctgatgctttatataaagaagtctacacattcgaaatgcagtatcgtggccgagaactaccagggtttgtgaattacaaaacatttgagaacatcataagaagacaaatcaaaaccctggaagaaccagctatggaaatgcttcacaaggtcactgaaattgtacgggctgcctttacaacggtttctgagaaaaatttctctgagttttttaatctccacagaactaccaagtccaaacttgaagacatcagattagaacaggaaacggaagcagagaaggcgatccggcttcacttccagatggaacaaatcatctactgccaggaccaaatttataggaaagccttgcagaaggtgagagaggaggaagctgaggaggaggagaggaagcatggcaaaagcaggtccgctcagtccccaaatttacagacctcatccatggatgaaatcttccagcatctgaatgcctaccgccaggaggctcacaactgcatctccagccacattccattgatcatccagtatttcatcttgaagatgtttgctgagaagctgcagaagggcatgctccagctcctgcaggacaaggattcctgcagctggctcctgaaggaaaagagtgacaccagtgagaagaggagattcctgaaggagcggttggcaaggctggcccaagctcagcgcaggctagccaaattccctggttaagctggccctgtcctttcctgtgtctcctggataattaaatattcagggacagaagggttccagccttgttgtggtttgccctaagatatctgtattttgatgctaattccactgccccagggacagctgcctagtcctgtactcaggaatcaggtgacttcaccagaaacttctccccattgaatttgtaaaatacaggtgaggggcacatagaggatagaaagaggcctgtaattggaccagaagtaaggattggtgggagagaagtttaaaggaaggggaggatactggaagggaaagaaggagaggagagagatagagagaagccatggcaggacaatatggcaggtgacattaagattccatgctgtacctttacaggttgttacaaatgttcttaagggatggatggtactgggctttgtatgtttaggtgggcaattatatcttaccaattgggtc

SEQ ID NO: 4210 - DNA, 1277 bp, Rattus norvegicus
  Genbank Accession No. NM_134352
tgcggccgcgaagaacccatgggcctcctgaggcggcggctgctgctgctggtggtggtggtgacgacctgtgtcccagcctcccagggcctgcggtgcatacagtgcgaaagtaaccaggactgcctggtggaggagtgtgccctgggccaggacctctgcagaaccacggtgcttcgggaatgggaagacgccgaggagctggaggtggtgaccagaggcctgtgccacaaggagaagaccaacaggaccatgagctaccgcatgggctcggtgatcgtcagcctcaccgagaccgtgtgtgccacaaacctctgcaacaggcccagacccggagcccgagggcgaccttttccccggggccgttaccttgagtgtgcatcctgcacctctctggaccagagctgtgagaggggccgggagcaaagcctgcagtgccggtatcctacagaacactgtattgaagtggtgacgctccaaagcacagaacggagcgtgaaggacgaaccctacaccaaaggctgtggcagtcttcccggatgcccgggcacagcaggtttccatagcaaccagacctttcacttcctgaagtgctgcaacttcacccaatgcaatggtggcccagttctggatcttcagagcttaccaccgaatggcttccaatgttacagctgtgaggggaacgagcacctttggatgttcctacgaagagacgtcctcattgactgccggggaccaatgaatcagtgcttggaggctacaggcttagatgtgctgggaaaccggagttacaccgtaagaggctgcgccacggcttcctggtgccaaggttcccacgtggccgactccttccagacccacgtcaacctctctatctcctgctgtaatggcagtggctgtaaccgccctacagggggcgcccccgggccaggccctgctcatcttatcctcattgcctccctgctcctgaccctcagactgtggggcatccctctctggacctgaatcctgagccgtctgccctggctggacccaggaacttttgactcctccgcctctgctccatctttgaggacaggcgtgctgtattgtcttcttgggcctcaagaactggaagagaattgagaaaagggctgcgggccagcaggggggcctcttggttgagttaatattgttgctgttattattattatcattgttattaccctaatttattatgtaaatatatatataagatttttgtaccagtaaaaaaaaaagcggccgcagaattcgat

SEQ ID NO: 4211 - DNA, 345 bp, Rattus norvegicus
  Genbank Accession No. NM_134361
atgagacttctcctcctgactttcctgggagtctgctgcttcgccgcatgggttgtggaaggtgtgggcactgaagtcctacaagagagtatctgtgtgagcttaagaacccagcggctgccagttcaaaaaatcaagacctacaccatcaaggagggagccatgagagctgtaatttttgtcaccaaacgaggactaagaatttgtgctgatccacaagccaaatgggtgaaaacagccatcaaaaccgtagatggcagggccagtgccagcaagagcaaggctgaaactattcccacacaagcccagaggtccgccagcacagcagtaaccctgactgggtaa

SEQ ID NO: 4212 - DNA, 899 bp, Rattus norvegicus
  Genbank Accession No. NM_134373
ggccgcgtcgacccggtccctccccctctgcagcagctgattggctcgcggagtctccgtgttcgatttggtgaagttggctcggctgctcgctggaaggctatgacggaggattggctgtggaaggggctcggagcgctttctcttaggaactgtggctgtgatccaggtggcccggccaggctccccgctgcgttccgcccgcctcgggcagccaagacaaccagagcacctgtgatgggaactccagcctctgtggtaagcgagccacccctgtggcaggtttcaacagctcagccccgggaccggggccgcggccgcaagcaggcctctgccaacatcttccaggatgctgagctggtgcagatccagggcctgttccagcgcagcggggaccagctggctgaggagcgggcccagatcatctgggaatgtgcaggggaccacagagtagctgaggcgctgaggaggctgcgcaggaaacggccgcccagacagaaccattgcagccggctcagagtgccagagctgggttctacagcggcggacccacaggccagcaccactgacacggcttccagtgagcagtttgggaactcccggaggacaagtgctagagtccaccgaaactggaataagccaggccccactggttacctccaccagatcagacactgacctgtgaagggtggggaggtcctccccaaatactgcagggactttcgccaaagggctcatggagttgtaagaaggacatctgtgcaggccctgcctaggtgaagaaagtagtaataagaatgccctcagttcagctcagaaccagcatgtgctggactgcactttcgggacctgttcttactaagtgatgcaataccaaggttgcccacgaatcagccttt

SEQ ID NO: 4213 - DNA, 879 bp, Rattus norvegicus
  Genbank Accession No. NM_134387
  misc_feature (1)..(879): n = a or c or g or t
cagactggggcaccatggacctggggcttgcaggtcggcgggcgctggtcaccggcgcgggcaaaggcatcgggcgcagcactgtgctggctttgcaggcggctggtgcacaggttgtggcggtgagtcggacgcgagaggacctggacagcctggtccgggagtgtcctggtgtggagcctgtgtgtgtggacctggccgactgggaggccacagaacaggccctaagcaatgtgggaccggtggaccttctggtgaacaatgctgctgtggctacgttgcagcccttcctggaggtcaccaaggaggcctgtgacacgtccttcaacgtgaattttcgggctgtcgtccaggtgtcgcagattgtggcnaggggcatgatagctcggggagttccaggggccattgtgaatgtctccagccaggcctcccagcgtgcactgaccaaccataccgtctactgttccaccaagggtgctttagacatgttgaccaaggtgatggccctagagcttgggccccacaagatccgtgtgaatgcagtaaaccccacagtagtgatgacacccatgggccgggccaactggagtgacccgcacaaagctaaggtcatgctggatcgtatcccacttggcaagtttgctgaggtggagaacgtggtagacaccatcctcttcctgctgagcaaccgaagtagcatgactactggttccgctttgccagtggatgggggcttcctggctacctaagccctccctaccaatactctgctcaactcatgttcagaacatcgtgccctccatccctccaataaagctctctgcccagcctgtgtgctgattctccacccaaaaaaaaaaaaaaaaaaaaaaaaaaaaa

SEQ ID NO: 4214 - DNA, 3765 bp, Rattus norvegicus
  Genbank Accession No. NM_134397
cctgacactaggagcacggggccgcaggactcggagtccttcgcccacactcggggagtctctggcacctcgcaagggcagcttcagtggcaggctaagcccagcctacagtctgggctctcttactggggcttcacctcgccagagcccccatgctcaaaggaagctttccagtggggacttgcgggtgcccatcccaagggagaggaaaaatagcatcacggagatcagcgacaatgaggacgatctcctggagtaccacaggcggcagcgccaagagcggctccgggagcaggagatggagaaggctggaacgccagcgcctggagaccatcctgaacctgtgtgctgagtacagccgagctgacgggggacctgagactggggaactgcccagtataggagaggccacggcagcactggctttggcaggcaggaggccctcaagaggcttggcaggagccatagtagtgtctggaaggagtggcgaggagtctggaggtgcctcgcagcgcctgtgggagagcatggagcgctctgatgaagagaatctcaaagaggagtgcagcagcacagagagcacccagcaggagcacgaagatgctcctagcacgaagctccaaggagaggtgctggctgtggaagaggagcgggctcaggttctggggcgcgtagagcagctgaaggtccgagtgaaggagctggaacagcagctgcaggaggcagcccgagaggctgaaatggagagagcactgctgcagggggagagggaggcggagcgagcattgctgcagaaggaacaaagagctatggaccagctgcaggagaagttggtggccttggagacaggcatccagaaggagagggacaaggaggcagacgctctagagactgagacaaagctctttgaggacctggagttccagcagctggagcgggagagtcgcgtggaggaggagcgggagttggccggccaagggctgcttcgcagcaaggctgagttgctgcgcagcgtgagcaagagaaaggagcgcctagctgtactggacagtcaggctgggcagatccgggcccaagcagtacaggagtcagagcgtctggcccgggaaaagaatgctgtcctgcagctactgcaaaaggagaaggagaagctgactgtgcttgagaggagatatcattcgctcacgggtggcaggccttttccgaagaccacctcaaccctcaaagaggtttaccgctccaagatgaatggtgacatggccagccccctgcccaggacccgtagtggccctctcccctcctcctcaggctcctcatcctcttcttcacagctcagcgtggctaccctgggccgtagtccttccccaaagagtgccctgctcgcccagaatggcaccagtagtctccctcgaaacctggcagccacgctgcaggacattgagaccaagcgccagctggccctacagcaaaaggtcgagttacctcctgccgagcccctctcacccgaagacccagcagggcaccaagtgatcgaggagcaacggcgacggctggctgagctgaagcagaaagcagcggcagaggctcagtgccagtgggatgccttgcatggtgcagccgcctttccagcaggcccgtctggcttccccacgctcatgcaccattctatcctgcaccacctgccagcaggcagggaacgtggagaggagggcgagcacgcttacgacaccctgagcctggagagttcggacagcatggagaccagcatctctacggggggcaactccgcctgttcccctgacaacatgtccagcgctagtggtctggacatgggcaagatagaggaaatggagaagatgctaaaggaagctcacgcggagaagagccggctcatggagtccagggagcgggagatggagctacggaggcaggccctggaggaggaacgtcggaggcgggagcaagtggagcggaggctgcagagtgagagcgcccgcaggcagcagctggtggagaaagaagtcaagctgagggagaagcagttttcccaggctcgacctctgacacgttatcttcccaaccggaaggaggactttgatttgaagacccacatagagtcgtcaggccatggggtggacacctgcctacatgtggtgcttagcagcaaggtctgccgtggctacttaatcaagatgggtggcaagattaaatcgtggaagaagcgctggtttgtctttgaccggctgaagcgcaccctttcctactatgtggacaaacacgagacgaagctgaagggggtcatctacttccaggccatcgaggaagtgtactatgaccacctgcgcagcgcagccaagagtccgaatccagccctcaccttctgtgtgaagacccatgaccggctgtactacatggtggccccatctgcagaggccatgcgcatctggatggatgtcatcgtcacgggagctgagggctacactcaattcatgaactaactaccaggcacctcctgggtcccccaggtcagccccaggacaccatgccctgccacttgctgctctgcttgtccctggagacagaggcacactgggcacgggccacaaagggtcaggatgtagttgagtaccccagggcttttgtgcaagaaaacgaaattgttctatgaggagtttggtgcttgggaatcaggctccggtccctaaagagccagcagagaggaaaggaagagggagaggccttgtcgcctcctgggagtccagaagtgcaggattccctcctgggtccagcaggctgaagaggcatagctgagctgtgactctcagctctgtcctggtacccacttagcccagcttactttctctctgtaaaggacaaattatggtaccagaatctgccaaagatcccctttctcatctcatcccctctacaggggtctggggggtcctgagcagagccacgtgtagaacaggggagaggctcaggcctgcacttcccgcccccggtctgcctccttctcctcccacctcccacttttcactacttagctcaaggaccagagacctcaagtgtcattctcgaggtccagccccgtaatcatgttacaagcccatcatccttgtctccatggtggctgcttcctcaccatggttacacactaattgccatggccactctgtggctctgcccactgcttcggctgtgggccacatgagggtacatgccacccatctctccaacccaggcctgggggcctgtcacatggtgggaggagatagagttcctcccggctgcagtgtgtctccagcccccagcccagccctctcccttttactgtgccttgcttagagccagaagggatgatgtccagagatccaagaccagagagcagcatcactgaggggagaggaagctaagaggtctgccctcccattctgacaggactagttcccaataaggaacgagggtggtagctcagagtgtctggaaagaagcctgagttgggagcagggcgggcagaagcagaggccctgagctgtggtaacctcccttcagtttcccaaaggtgacgggaaagaaggacagaggatcaagtctccagctggctggcctcagccttgcgccttaacactaagccaccttccctgccctccccagcactgggcccttggttgctgggcctggctgggtgttttgcagtatttgtaagcatttcagcagaacaataaaagcattttgactatgtaaaaaaaaaaaaaaaaaaaa

SEQ ID NO: 4215 - DNA, 4715 bp, Rattus norvegicus
  Genbank Accession No. NM_134399
cggcacgagcctgcctgccacgttggaccagccactgtctactggccttccgtgtggataagcattttgctggccttcagtgtggctggttccctctcttggtgaggaaatctaaaagttctcatgaatttgaagtctgttggaggcactggacaccatcacccttccagaggaagctactaggtagcccttccttgtctcaggagagccatcgaatttccacccacttcctagccatctcccacagaggcctacgtaccaaaaggacccagccttcagctgcagaagggatagaacatctccctggagcaggttcacaaaagcatggaggacctgaattctcctttgatttgctgcctgaggtacaggctattcgggtgactattcctccaggcccagaggccaacgtacgcctttgttaccagtgggcactggaatgtgaggacatgagtagtccttttgatacccagaaaattgtgtctgggggccacactgtagacctgccttatgaattccttctgcttgcatgtgcatagaggcctcctacctgcaggaggacactgtgaggcacaaaaagtgtcccttccggagctggcctgaagcttatggctccgacttctggaagtcaatacgcttcactgactacagccagcacagtcagatggtcatggctctgacactccgctgcccactgaaactggaggcctctctctgctggaggcaggacccagtcacgccctgcaaaatccttcccaatgccacagcaaaggagtcagaaggatggtatatcctggagaatgtggacttgcacccccagctctgctttaagttttcttttgaaaacagtagccatgttgaatgtccccaccagagtggctctctcccatcctggactgtgagcatggatacccaggcccaacagctgattcttcacttttcgacgaggacatatgctaccttcagtgctgcctggagtaacccaggtttggggctggatagctccatgactcctgtgtacagcatcagtcagacccagggctcagttccagtgacactgaacctcattattcccttcttgaggcaggggagctgcatcctggtgtggaggtcagatgtccagtttgcctggaagcacctcttgtgtcctgatgtctcccatagacacctcgggctcttgatcctggcactgctgggtctcaccactctactgggtgtagttctggtcctcttctgccggcgcctactgccaggccccggtcgaacaaggccagttttactcctacacgcagcggactcggaggcacagcgacgcctggtgggagctttggccgaactgctgcggaccgcgctgggtggtggacgcgacgtgatcgtggatctctgggaagggacgcacgtggctcgcattggaccactgccatggctctgggcagcacgggaacgcgtggcacgggagcagggcactgtgttgctcctttggagctgtgcgggccccagcactgcctgcagcggcgacccgcagactgcatcccttcgcaccttgtcgtgcgctgctccacgccagctgctgctcgcctacttcagtcgcctctgtgccaaaggtgacattcccgggccgctgcgcgctctaccgcgctaccgcctgcttcgtgatctgccacgcctactgagagcgctggatgcgcgacctgccaccctagccactagctggagtcaccttggagctaaggagtgtttgaaaagtcgcctggagctgtgtcacctgctggaactcgaggctgccaaagacgactaccacggttcaaccaatagtccttgtggcttcagttgtctgtagctacagcctgtgtagcaacagcagtaactccagaacgaggccgcaaacatgtactctttgggggtgcttcttgtccccccaaaccgtgagactcatcctaggacccacacttgaccagcctccctctcacatttgctccttctcagagtccctgagagaaagttgggctttcctgataggtcctcggcccattctgaggaggaggggagattttcccaattcttctcacaactgcaaaaagacaaccgattgcttggtgtactctagtcccggctggagagctagaccagggttggaaagcagggcctacgtgtcaagctcgtgaagagtgttctgcttggcagagttgagagaacctcgtgccgaattcggcacgaggacatttaattcgggctggcttacaggttcagaggttcagtccattatcgtcaaggtgggagcatggcagcatacaggtgggcatggtgcaggaggagctgaattctacatcttcacccaaaggaagccaggaacagactgagcatcctcaggcagctaggaggagggtctccaagcccatccccacagtgacacaccctccaacaaggccacaccttctaatagtgccactccctgggccaagcatatgcaaaccatcacagtgcgttatgacatcatcctacattttctatcactcattttaaaagaaatacttttagtttttctccagtcagtataatggattctgtagctccttttttttattggttattttatttacttacatttcaaatgttatccccctcccagtttgccctctgaaaatcccctaacccatcttatcgccctccccctggttttatgaggctgctccccatctatccatccacttcagcctcgctgccctagcattcccctatgctggggaatcaagctttcccaggaccaagggcccctctcccattgatgccagacactgccctcctctgcagcatatgcagctggagccatggatccctccatgtgtgctctttggttggtggtttagtccctgggagctctgggagtctggttggttgatgttgttgttcttcctatggggttgcaaaccctttcagctccttcagtccttcccctaactcctccattggggtccccatgctcgatccaatggttggctgcaagcatcctcatctgtgtcactaaggctctggagagcctctcaggggacacccatatcgggctcctgtcagcaagcacttcttggcgtccatagtagtgactgggtttggtggctgcatgtgggccacagatgtttctgtggggacagcaagtcaccccggggcactccagggtgcccttacccctgagactgctcagatctccatgtgacgacagacacaggatcgacaggaagatgacatgaagagaccgcttccgaacaaggaacgttagagcttaaaaagtagccgggcccagcacacatgcgatcataagccctgcactgggtaggtcgagggaggagtcagcctcagctacacagtgacttggaggctagcctgggctataggagacccagtctcacaaacaaaaagatccagggatgagaagttgcttcagaattcacatccatcaatcccatggggacagcgaggcctccgaccacccataaaagaaaggtggtgtctacaatactgtggcttcactggcagggactagacttggtcttggaaggagtccaggtcacatgtcacatcccacccttcctgagagcccctccctcctggcctggaagttcaaagtcagctggagacaaaggctggctggcgtcccagacacacttccaaatgcacttcaaccgatatccctgtggccgatgcgacatgttgggacatgcctgggcaccccagctctggtcctaggtccctaacaggatattagaggctgtctacctcaggatgcagaacatccacagagcctgggtgacggttcactgtaggttctaggtccccggtgggccatgtgtgtggcaaacacctgtccgactcccagaacttaggaagctgaggccagagaattaggagttcacatgaggccaacctggattacagaatgagttcaaatggccagcctgagctacctgagaccctgtctcaaaaagaacaacaacaaatactctcaaaattttagagtctctaaatttttagtctaaaaaaaatcagagttctggacagcagcacgtgtcctgacgagctctctctacccccagtcagccagcctgatcccagcctgtgatcccagcagcagcccgcagagcagccccagctgcagcgtcatggcacggtggcagatggcacctgtcaggacacggccattggccattgtaggctacaaggatttgccctccatctgggctgccatccctgggaagaacttcgttagcattacacttgctgagtttggtctcatggtaggcaaagactggtcaagttttttcatgaatagcttgacgcttgggggccaaaaaatgttctgtgatccaggactcactgctgcaagtcggggaatttacaatgggtcttcataccaagagcactggaggaacccccaccttcaatgtcactgcaccatgactgccaagatgctcctgctgatgggcaaagaaggtacccacggtggttggatcaacaaccacggtggttggatgttgtgaaatggcctctcacctgcggcacccccttttttccacacacaccattatttttttggggtcgttaccccatttcccttattgctgtcaaaaccacatggggtctggggctggacggacaggtacttccccctacccaaaccccctctcctgggtctggaatacccacaccaagtttgcctcgtgccg

SEQ ID NO: 4216 - DNA, 4514 bp, Rattus norvegicus
  Genbank Accession No. NM_134403
tgaagtttgtggagcgctttctcaccggctggtccgggacgatagccggcgcctcgctcttcggtgaccgccccattctctcgggattccttctctgtggtgacggacgctctagacgctcggtaagggaagctgaggctggcggcgggagttcagaggaggagcgcggagaggttgctcgctgacagcggcgcggctggacgcggacggcgtcgggctctggccggctgagagcttcgcccaccttccccgcggcctgtgcgcaggcgatgctgcggccccgaggcgcggcgcggcgagcagggagggcgcctccgagagcctagagctggtttccgtcctcttccccggggcaagtgggcatggaacagtgagagcccctcgctcggcgaggccgcgcgcggaggctccccatggccgggacgtacagctccacattgaagactctggaggacttgaccttggactccgggtatggggccggcgactcctgccgctcgctcagcctttcgtcttccaagtccaactcgcaggcgctcaactcttcggcgccgcagcaccgcggggcggcctggtggtgctactccggctccatgaacagccgccacaacagctgggacaccgtgaacacagtgctgcccgaggatcccgaagtggccgacctcttctcgcgctgcccgcggctcccggagctagaggagttcccttggaccgagggagacgtggctcgggtgctccgcaaaagcgtcggcggccggaggctgccctcattctccgccgaggctgtgaggcgcttggccggactcctccgccgggcgctcatccgcgtggcccgggaggcgcagcgcctaagcgtgctgcacgccaagtgtacccgcttcgaggtgcagagtgcggtgcgcctggtgcacagctgggcgctggccgagagctgcgcgctggcagcggtcaaggcgttgtccctctatagcatgagcgctggcgatgggctgcgccgcggcaagtcggcacgctgcggcctcactttctccgtgggccgtttcttccgttggatggtggacactcgcatctccgtgcgcatccatgagtatgcggccatctcgcttacggcttgcatggagaacttggtggaggagatccgggctagggtcctggcgagtcagagccctgatggcggaggggcaggaggcggagaggtatccgctgaggccttggagatggtcatcaacaacgatgccgagctctggggagtcctgcaaccctatgagcatctcatctgcggcaagaacgccaatggtgtcctctccctccctgcctacttcagtccctacaatggtgggtccctgggccatgatgagcgagcagatgcctatgctcagctggagcttcggacactggagcagtcactcctggctacctgtgtgggcagcatctccgagctgagtgatctggtctctcgagccatgcaccacatgcaggggcgccaccctctgtgcccaggcaccagccctgctcgccaggcccgccagccaccacagcccatcacatggtcccccgatgctctccatacactctactacttcctgagatgtccacagatggagtccatggagaaccccaacctggatcccccaagaatgaccctgaataatgaacggcccttcatgctgctgccaccactgatggagtggatgcgggtggcaatcacctatgcagaacaccgtcgcagcctcactgtggacagtggcgatatccggcaggcagcccggctgctgctaccaggcctggactgcgagccccgccagctcaaacccgagtgctgcttcagttccttccggaggctggacgctcgagctgctactgaacgcttcaaccaggacctgggcttccgcatgctcaactgtgggagaacagacctcatcagccagccatcgagccctgggccagacggggtgaacacaatggatgaccagggtctgacaccgctaatgtacgcctgtgctactggggatgaagccatggtccagatgctcatcgatgctggagcaaacttggatatccaggtcccaagcaactctcccaggcatccttctgtccatccagacagcaggcactggacctccctgacattcgcggtgctgcacggacacatctctgtagtgcagctgctacttgatgctggtgcccatgtggagggctcggccgtgaacagtggggaggacagctatgccgagacaccccttcagctggcctctgcagccgggaactatgagctggtgagcttgctactgagccgaggtgccgaccccctcctcagcatgctggaagccaatggcatggcttcttccctccatgaggatatgaactgcttcagccactcagctgcccatggccacaggaatgtcttgaggaagctcctgactcagccacagcaggctaaagcagatgtgctgtccctagaagagatcttggctgagggcgtggaggaaagcgacacatcgagccagggcagtagcgaggggcctgtgaggttaagccggacccgaacgaaggccctgcaggaagccatgtactacagtgctgaacacggctacgtggacatcacgatggagctgagggcactaggtgtcccctggaagctgcacatctggatagagtctctgcggacctctttctcacagtcacggtactcggtggtgcagggcctcctgagagatttcagctccatcaaggaggaggagtacaatgaggagctggtgacagaaggcttgcagctcatgtttgacatcctcaagaccagcaaaaatgactccgtcctccagcagctggccaccatcttcactcactgctatggcaccagccccatccccagcatcccggagatccggaagaccctgccagccaggctagatcctcactttctgaacaacaaggagatgtctgatgtaaccttcctcgtggaaggaaagctgttttatgcacacaaagtccttttggtgacagcatctaacaggttcaaaaccttaatgaccaataagtcagagcaagatggggacaacagcaaaaccattgagatcagcgacatcaagtaccacatctttcagatgctgatgcagtacctgtactatggaggaacagagtccatggagatccccacggctgacatcctgcagctcctgtcagctgccaacctgttccagctagatgccctgcagagacactgtgagatcctgtgctcccagacccttagtgtggagagtgctgtcaacacctacaaatacgccaagatccacaacgccccagagctggccctcttctgtgaaggcttcttcctcaagcacatgaaggccctgctggagcagatgccttccggcagctcatctatggccgaagcagcaaagtccagggcctggacccactgcaggatctgcagagcaccctagctgagcgagtacattctgtctacgtcacctcccgggtgtgagccagggtggatggtgactgctatctgagggtgtacaaaggtctgttaaagccagaaaccaccagcgacacccccagtggagggaggcttgtaggccttctggggtaggctctcggggggtacgtcctgctcttcccctagattaccctctgtggtgttgactgatcctgaggtggaaggagagtccacttcactgttgctcggccagtaactggcaggggtgtgacgtaattgcaccctgagggctaccctgtgccctctcccctccagtggctcagcgtcgagccgatccacctcagcaccagccatcctggctggggatgttaggatcacaggcattcttatgaatgtagaaagtgtccgagcccaggccactgggtgcaggagccgctatgtttggtttcctaacagagagaggctaagtcctgccctccaagctgtgcctttgaaagggctgggccctgttggtgaaaaccagacctccagtgccctccctacaagactactaacgagagtctgaactgggaatccctgagcaccgggtatgctgggctacaggagctggcagccacaggaggcccagccccatcatgtctgtaggctgaggcagcagggcttcaatggcctcaagtgcagggcgccttccactcagggctggggtgcaagagcacacttctcacctgggttccgtgactctggggcatgaacggacagggccttggtggaagagaagctgtgtcctctcccctcctgtcctcagtcttggctccccatcctctgacctgtttgtggacagacgctgggacacgatcaagaacagctaccttagaaactatttattcatcagaagcccccagggcttgcaatcctggaacaatattttcaacttgctgcttgtgctggatgtacaaaagaatgaatggtattttattgctgtaatattgtatgatactgtaactataccttaatgttgttacttactgtaaatgtactatggttttatcaacaataaacactcattaacattgac

SEQ ID NO: 4217 - DNA, 1272 bp, Rattus norvegicus
  Genbank Accession No. NM_134407
cgctgctgtacgctgcgcgtggcgctctgggccttcggtcgcgcgtcctctcgccatgtcccggtctccggcaccccgcgccgtctctggcgcccctctccggcccggtacggtgctgggcaccatggagatggggcgccgcatggatgcgagtgctagcgctgcgaccgtacgcgccttcctggagcgcggcctcaacgagctggacacggccttcatgtattgcgacggccagtccgaaagcatcctgggcagcctggggctcgggctgggcagcggcgactgcacagtgaaaattgccaccaaggccaacccttgggacgggaagtcgctgaagcctgacagtgtccggtcccaattagagacgtcattgaagcggctgcagtgtccccgggtggacctcttctacttacacgctcctgaccacggcactcctatcgtggagaccctgcaggcctgccaacagctgcatcaggagggcaagtttgtggagcttggcttgtccaactatgcctcctgggaggtagccgagatctataccctctgtaaaagcaacggctggatcctgccaactgtgtaccagggcatgtacaacgccaccacccggcaggtggagactgagctcctcccctgcctcagatacttcggactgaggttctatgcctacaaccctttggctggaggcctgctgactggcaaatacagatatgaagacaaggatgggaaacagcccgagggccgcttctttgggaatagctggtctgagacctacaggaaccgcttctggaaggaacaccactttgaggccattgccctggtagaaaaggccctgaagaccacctatggcaccagtgcccccagcatgacctcggctgccctgcgctggatgtaccatcactcacagctccagggcacccgaggggacgcagtcatcttgggcatgtccagcctggagcagctggagcagaacttggcggccactgaggaaggtcccctggagcccgctgtcgtggaggcctttaaccaagcctggaacgtggtcgcccacgagtgtcccaactacttcagatagactgtcgtgactcaagacgccagggcttttctgccaactcttagagtcacaccctggccactccttgcccagtgctgacctagtgtggtcttttctgctggtctccatccactccctgctcttttcccgtctgaataaagcaggcgtccgacctagctgcagcccggactgaaaaaaaaaaaaaaaaaaaaaaaaaaaaa

SEQ ID NO: 4218 - DNA, 5602 bp, Rattus norvegicus
  Genbank Accession No. NM_134408
gaaaatatttaaagggatcaataatggtgtcttctggttgcagaatgcgaagtctctggtttatcatgataatcagtttctcaccgaataccgaaggtttcagcagagcagccttgccattcgggttagttagacgagagctgtcctgtgaaggttattctatagacctgcgatgtccgggcagtgacgtcatcatgatcgagagcgcaaactacggtcggacggacgacaagatctgcgacgcagacccctttcagatggagaacacagactgctacctccctgatgccttcaaaatcatgactcaaaggtgcaacaaccgaacacagtgtgtagtagttaccgggtcagatgtatttcctgatccatgtcccggaacttacaaataccttgaagttcaatatgaatgtgtcccttacatggagcaaaaagtytttgtgtgtcctggaaccttgaaagcaattgtggactctccaagtatctatgaagctgagcaaaaggcaggtgcttggtgcaaggacccccttcaggctgcagataaaatttattttatgccctggactccctaccgcaccgataccttaatagaatatgcttctttagaagattttcaaaacagccgccagacaacaacatacaaacttccaaaccgagtggacggtactggatttgtggtgtatgacggggcagtcttcttcaacaaagaaagaacgagaaacattgttaaatttgacttgaggactagaatcaagagtggggaggccataatcaactacgccaactaccatgacacctcaccctacagatggggggggaagactgacattgacctggcagtggatgaaaatggcttgtgggtcatctacgccaccgagcagaacaacggaatgatcgtgattagccagctcaatccgtacactctccgattcgaagcaacctgggagacgacgtatgacaagcgtgcggcgtccaatgctttcatgatatgcggggtcctctacgtggtcaggtcagtgtaccaagacaatgaaagcgaagctggcaagaacgtcatcgactacatttacaacacaaggttgagccggggagagcacgtggacgttcccttccccaaccagtaccagtacatcgctgcagtggattacaacccaagagacaaccaactctacgtatggaacaataactttatcttacggtattctctggagtttggtccacccgaccctgcccaagtgcctaccacagctgtgacaataacttcttcagctgagctgttcaaaaccacagtgtcaaccacaagcagtacttcacagagaggccccgtgagcagcacagtcgctggtcctcaggaaggaagccgagggacaaagccacctccagcagtctctacaaccaaaattcctcctgtaacaaatatttttcccctgccagagagattctgcgaagcgttagaaatgaaggggataaagtggcctcagacacaaagggggatgatggttgagcgaccgtgtcccaagggaacaagaggaacggcctcgtatctctgcatggcttccacaggaacctggaacccgaagggcccggatcttagcaactgcacctctcactgggtgaatcagctggcccagaagatcagaagtggagagaatgctgcaagtctggccaacgaactggctaagcacaccaaggggacggtgttcgctggggatgtgagctcctctgtgaggctgatggaacagttggtggacatcctggatgcccagctgcaggagctgaaaccgagcgagaaggactcggccgggaggagttataacaagctccaaaaacgagagaagacatgcagggcttaccttaaggccattgtggacacagtagataaccttctgagagccgagactttggactgctggaaacacatgaattcctcagagcaggcgcacacagccaccatgctgttggacaccttggaagaaggagcatttgtcctggcagacaaccttttggaaccaacccgggtctcaatgccaacggataatattgttctagaagtcgctgtcctcagcacggaaggacaggtccaagacttcaccttccatctcggcttcaagggggccttcagctccatccagctctcagccaacaccgtcaagcaaaacagcagaaacgggctggcaaaggtggtattcatcatttaccggagtctgggaccattcctgagcaccgaaaatgcgaccgtcaaactgggcgcagacctcctgggtcggaacagcaccatcgcagtgaactcgcacgtcctttcagtctccatcaataaggagtccagccgtgtgtacttgacagacccggtgcttttttcaatgccacacattgattctgacaattatttcaacgcaaactgctccttctggaactactcagagagaaccatgatgggatattggtctacccagggctgcaagctggttgacactaataaaactcgcacgacgtgtgcatgcagccacctaaccaattttgctattctcatggcccacagggaaattgtgtacaaagatggcgtccacaaattgctgctgacagtcatcacctgggtgggcatcgttgtctccctcgtctgcctggctatctgcatcttcaccttctgcttcttccgaggcctgcaaagcgaccgcaacacgatccacaagaacctgtgtatcaacctcttcatcgctgagtttattttcctaataggcattgataaaacacagtacacgattgcgtgccccgtgtttgcaggactcctgcactttttcttcctggctgctttttcctggatgtgcctagaaggtgtgcagctctacctcatgttggttgaagttttcgagagtgaatactcaaggaagaagtattactatgtcgccgggtacctcttccctgccacagtggtcggtgtttcagctgctatcgactccaagagttacgggacactagaggcttgctggcttcacgttgataactatttcatatggagtttcattgggcctgttactttcatcattctgctaaatattattttcctggtgatcacgctgtgcaaaatggtgaaacattcaaacactttgaaaccagattctagcaggttggaaaacattaataattaccgtgtttgtgatggatactataatacggacttacctggctatgaagataataagccatttatcaagtcttgggtgctcggtgcgttcgccctgctgtgtctcctgggcctaacctggtcctttgggttgctttttgttaacgaggagaccgttgtcatggcttatctcttcaccgcctttaatgctttccagggactgtttattttcatcttccactgtgctcttcaaaagaaagtacggaaagagtatgccaagtgcttcagacactggtactgctgtggcggcctcccgaccgagagcccgcacagctctgtaaaggcgtccacctcccgcaccagtgctcgctactcctctggtacacagagccgtataagaaggatgtggaatgacaccgtgaggaagcagtctgaatcgtcttttatctcaggtgacatcaatagcacttctacccttaatcaaggaatgactggcaattacctactaacaaaccctcttcttcgaccccacggcactaacaacccctataacacattgctcgctgaaacagttgtatgtaatgccccttcagcgcccgtgtttaactcaccaggacattcactgaacaatacccgggacaccagcgccatggatactctaccgctaaatggtaacttcaacaacagctactccctgcgcaaggccgactaccacgacggcgtgcaggttgtggactgtggactaagtctgaacgacaccgcgtttgagaaaatgatcatttcagagttagtgcacaacaacctccggggtagcaacaaaacccacaacttggagctcaagctcccagttaaacccgtgattggcggcagcagcagcgaagatgacgcgatcgtggccgacgcctcatctttgatgcacggtgataacccagggctggaattccgccacaaagagctggaggcaccgctcatccctcagcggactcactcgcttctgtaccaaccccagaaaaaagtgaaacccgaggcaaccgacagctacgtctcccagctgacggccgaggccgacgagcacctccagtcccccaacagagactctctgtacacgagcatgcccaacctaagagactctccctacccggagagcagcccggacatggcagaggacctgtctccctccaggaggagcgagaacgaggacatttactacaaaagtatgcccaatcttggggctggccgccagctccagatgtgctaccagatcagcagaggcaatagcgatggctacatcatccccattaacaaagaagggtgcatcccagagggggacgtcagggaaggacagatgcagctggtaacaagtctttaatagtacagctaaggaattcctagggccacatgcaagtattaactgctaaagactgtgccagccggccctgcagctctccccaactcggccagtagaaccggctctgctggccggcggttctccactgtaggaaaaaaaaatggactgaacctcgcggttctgtgaatttttataaaacatgcaaaaactttgtatatacacagagtatactaaattgaattatttgttacaaagaaaaaagaaatgccaaccaggtattttacgtttctgctgctgtgtagagagattgtaaaacaaacaggagaccctcccagccatgatcccgcggcagttggtgaactgagtctgtaaatagaaccctaccgttttgggttttttttgtttgtttgtttgtttttgtttttgttttgtaggcctgcattgtattatatacaagacgtaggctttaagatcctgtgggacaaattgactgtatcttacttttcctgacaagacttggaaaagcaggagagagattctgcacccgtttgcacttccctgcaaaccttttacattaaggcagccaccgaaaccatgtttaaccagtagcaatcaagccacaggccttatctcatgtttcctcaactgtacaatgaactgttctcatgaagaaaaaaaaagttaatggctaaagaaaattatattttgttctattgctagggtaaaaataaatacatttgtgtccaactgagatatcattaaaataattttaaaaagagtttggagaaaatatcgtgtcaagctcttggttgcacaaaataggcgatgtctcttctcccacccaccatggtgagtttgtgcccctctttgttggttcccactgtagacggtgtctgctctgaccgcttagccccctttcttacacttaaatttcttattgccaaaagagtgtgttttatggggagaaaactctttgaagtcctgccatgccttgcacaaatgtggggaaatctggaggtcttgagtcaaccctctgtttattctggaacagagggcgaaggggtcactgggcacttctcacaaactttctagtgaacaaaaggtgcctattcttttataaaaaaaaaaaaaaaaaa

SEQ ID NO: 4219 - DNA, 1330 bp, Rattus norvegicus
  Genbank Accession No. NM_134410
gggttagtttaacatgggttcctccagctccaccgctctggctcgccttggactccccgggcagccgcggtccacctggctcggcgtcgccgcgctgggactggccgcagtggcgctggggaccgtggcctggcgtcgcgcgcgtccccggcggcgccggcagctgcagcaagtgggcacggtgtcgaaggtttggatctacccgatcaagtcctgcaagggggtgtcggtgtgcgagactgagtgcaccgacatggggctgcgctgcggcaaagtgcgcgacaggttttggatggtggttaaggaagatggtcacatgatcactgcccgccaggagcctcgccttgtgctggtcaccatcaccttggagaacaattacctgatgctcgaagctccaggcatggagccgatagttctgcctatcaagctgccctcttcgaataagatccacgactgcaggttgtttggcctcgacattaaaggcagggattgtggcgatgaggtggcccggtggttcaccagctacctaaagacgcaagcctacaggttggttcagtttgataccaaaatgaaaggaaggacaacaaagaaactctacccgtcggagagctaccttcagaactatgaggtcgcctacccagactgcagccctatccacctgatttctgaagcctccttagtggatctcaacaccaggctgcagaagaaagtgaagatggagtatttcaggccgaacatcgtggtgtcaggctgcgaggctttcgaggaggacacctgggatgagctcttgattggtgacgtagagatgaagagggtgttgagctgccccaggtgcgtgttgactacagtggacccagacaccggcatcatagacaggaaagagccgctggagaccctgaagagctatcgcctgtgtgatccttctgtgaagagtttataccagtcgtctccactctttgggatgtatttctcagtggaaaaaattggaagcctgagagtgggtgaccctgtgtatcggatggtggattagtggatcccgtggactgactcggtttggattattcacaactgacagtctgagtaacagagtgatggggaatcttgtcatttactcggcttccctgggagacgacgcatctgcaagtcctcacggccatcttcctggaaatggatctctgttcttcctctggagctgcacatgcccgagttcattcaagaaagctaccagaggtggtttgggaatgtgacggtgtataaattttagataatgaggttttaaaaaattaaacggaattgttactcccacggttaaaaaaaaaaaaaaaaaaaa

SEQ ID NO: 4220 - DNA, 1037 bp, Rattus norvegicus
  Genbank Accession No. NM_134415
ggcacgaggtaacactgggattaagaagtttttagaacccgggaggtcgcggaccgctgcttcgcggctgtcatcatgccacaaaatgaatatattgaattgcaccgcaaacgatatggatatcgtttggattaccatgagaaaaagagaaagaaagaaggtcgggaggcccatgaacgttcaaagaaagcaaaaaaaatgatcggcctgaaggctaagctctaccataaacagcgccatgccgagaaaatacaaatgaaaaagaccattaagatgcatgagaagagaaacacccaagcagaagatgacgagaagactccacagggagcagtccctgcctacctgctagacagagaggggcagtcaagagcaaaagtactttccaacatgattaagcagaagcggaaagaaaaggcgggaaaatgggagtcctctacccaaagttcgtgcccaaggagaaacagaattattgaaagttatttcgaacaggaaaaagaaaaaagaagcttggagagaatggttacaaagtctgctttgttggtgatggttttacaagaaaaccacctaaatatgaaagttcataggccaatgggtttacgtttcaaaaaagcccatgtcacacaccctgagctgaaagctaccttttgccctgcctatactcggtgtgaaaaagaacccctcctccccgttatatacaaccctgggtgtgatcaccaaagggacagtcattgaagtgaatgtaagcgagctgggccttgtgacacaaggaggcaaggtcatttgggaaagtatgctcaagttaccaacaatcctgaaaatgatgggtgcataaatgcagtcttgctggtttgacagtggcatcatacaagtcactccactcactacggaagactacagtgtcaggaaaacaccatcgctgtgatccttttgaactaccaatcagccttaccccattgcagtcatcaggaagtatttattaaactgtaaaggaaaataaaacactgcccaatttacagtggaaaaaaaaaaaaaaaaaa

SEQ ID NO: 4221 - DNA, 1560 bp, Rattus norvegicus
  Genbank Accession No. NM_134419
cggtgctacgcctcacctggcgctctctccatccttggcgcgataaccatggaagcaggctgcgaggggagctcgccccagaccctgggcgagagaactatgggggaggaaggtgaacgtgtcaaaccttttacaccagagaaagcaaaagaggttataatgtctttacagcagcctgcaatcttctgtaacatggtttttgattggccatcacgacactggactgcgaaacacctttctaaggtcttggagggcaagcagatacgattcaggatgggcctgagaagcaccggcacagttcctcagtttgaaaccgaatgcagttacgtggatgctacacttgaggagtttttggcctggaactgcgaccagtctagaatctctggaccatttaaaaagtatgatcattccaaattctgggcttatgctgactataaatattttgtcactctatttgaggacaagacggatgttttccaggaggtgatgtggtctgattttgggtttcctggaagaaatggacaagaaagtacattgtggatcggatccctgggagcccacactccctgtcatctggactcctatggttgcaacttggtattccaagtacaaggaaggaaaagatggcatctctttcctcctgaagatacacctttcctttatccaaccagaattccttacgaagaatctagtgtgttcagtaaaatcaatgttgtcaaccctgatttaaagcgtttccctcagttccagaaagctcgaagacatatggtcacactgagcccaggacaggttctgtttgttcccagacactggtggcattatgtggagtctcttgatcctgtcaccgtcagtataaactcctggattgagctggaggaggaccacctcgcccgggtggaggaggcggtcacccgaatgctcgtgtgcacactgaagaccgcagaggacccgcaccaccccaggacctggctgaaccccactgaggttgaggaaacgtctcatgaagtcaatagctgctacttgaacagtgctgtctgtgcattttttgatcattgtgaaagagctaaagaagtagaaatgcaagctccgagagcaaacggggaggagccgggttgtgcaggagcacatggaagtggagcaggcgcgagacccgagctccgaagtgggggctgggaaacaggaggccgcgagtccgtttggcccagatctggttcctgtgacaccagcatcggaagagagaggaggcgcactggaaggagacagccaggagtgtaccagcagaaacggagaacactgtgcagaactgccctgcgccaggaggcagcaagccagtaaaggagcacgcgcggaggcagggcagtcggccccgaggtatcctgtggcgccttctagagtcttcgtgtccacggatgacctgctggactgcttagtcaatccacaagtaaccaggatggtggcccagcttttgatacaaggaaaaagcttgtgatactttttaaataactttttaattacttttaaataaccttttaaaatatatttttagaaataataaaaaaa

SEQ ID NO: 4222 - DNA, 1434 bp, Rattus norvegicus
  Genbank Accession No. NM_134432
atgactcccacgggggcaggcctgaaggccaccatcttctgcatcctgacctgggtcagcctgacagctggggaccgcgtatacatccacccctttcatctcctctactacagcaagagcacctgcgcccagctggagaaccccagtgtggagacgctcccagagccaacctttgagcctgtgcccattcaggccaagacctcccccgtggatgagaagaccctgcgagataagctcgtgctggccactgagaagctagaggctgaggatcggcagcgagctgcccaggtcgcgatgattgccaacttcatgggtttccgcatgtacaagatgctgagtgaggcaagaggtgtagccagtggggccgtcctctctccaccggccctctttggcaccctggtctctttctaccttggatcgttggatcccacggccagccagctgcaggtgctgctgggcgtccctgtgaaggagggagactgcacctcccggctggacggacataaggtcctcactgccctgcaggctgttcagggcttgctggtcacccagggtggaagcagcagccagacacccctgctacagtccaccgtggtgggcctcttcactgccccaggcttgcgcctaaaacagccatttgttgagagcttgggtcccttcacccccgccatcttccctcgctctctggacttatccactgacccagttcttgctgcccagaaaatcaacaggtttgtgcaggctgtgacagggtggaagatgaacttgccactagagggggtcagcacggacagcaccctatttttcaacacctacgttcacttccaagggaagatgagaggcttctcccagctgactgggctccatgagttctgggtggacaacagcacctcagtgtctgtgcccatgctctcgggcactggcaacttccagcactggagtgacgcccagaacaacttctccgtgacacgcgtgcccctgggtgagagtgtcaccctgctgctgatccagccccagtgcgcctcagatctcgacagggtggaggtcctcgtcttccagcacgacttcctgacttggataaagaacccgcctcctcgggccatccgtctgaccctgccgcagctggaaattcggggatcctacaacctgcaggacctgctggctcaggccaagctgtctacccttttgggtgctgaggcaaatctgggcaagatgggtgacaccaacccccgagtgggagaggttctcaacagcatcctccttgaactccaagcaggcgaggaggagcagcccacagagtctgcccagcagcctggctcacccgaggtgctggacgtgaccctgagcagtccgttcctgttcgccatctacgagcgggactcaggtgcgctgcactttctgggcagagtggataacccccaaaatgtggtgtga

SEQ ID NO: 4223 - DNA, 1049 bp, Rattus norvegicus
  Genbank Accession No. NM_134449
gccttcggttttagggagagcaggccgggcggtcagagatcatgggggagagcgcactggagcccgggcctgtgcccggggcgccggctgggggtccggtgcacgccgtcaccgtggtgactttgctggagaagctggccaccatgctagaggcgctgcgggagaggcaggggggcctggctgagaggcagggcggcctggcgggctcggtgcgccgcatccagagtggcctgggcgcgctgagtcgcagccacgacaccaccagcaacacactggcgcagctgctggccaaggcggagcgcgtgggctcccacgccgacgcagcccaggagcgggcagtgcaccgcgccgctcaggtgcagcgactggaggccaaccacgggttgctggtggcgcgcgggaagctgcacgtcctgctcttcaaggaggagactgaaattccagcccgcgccttccagaaagcaccagagctcttgggcccggaggaccagttggtgctaggcccagagcagccagaggatgaagttggagagagttctgatgaggaacccgtggagtcccgggctcagcggctgcgacgcactggcttacagaaggttcaaagcctgaaaagggctttttccagtcgtaaaggctctgaagcagcacagcccacgccagtcaagccgccacgcctaggtcctgtccggaactccgaaggcccggcagaaggccagcctgcagctcagcctgcaatggagcctgtgctcccgtctgccctggagccagaacctcctcagcctaccaaggaagatcctgagagacctgtgcttcaaatagagagcgcagcctgatccctggggctgcctgccccattcagcccttatgccttgtcccaaaaataaatactaatcgagtgcagcacttacatccaaataaggagagaatcctgcatccactgcccggctccaatccttccttcctggttttccagtctggtaccctgtgtcctctgaaagaggaacattcggccttgtttaggttcaccaccaataaaagtaattttctct

SEQ ID NO: 4224 - DNA, 2373 bp, Rattus norvegicus
  Genbank Accession No. NM_134456
atgaatggtgccccttccccagaggatggggttttcccttctccaccagcgctgccaccaccccctcccccaagttggcaagagttctgtgagtcccatgcgagggctgctgccctggatcttgctcgccgttttcgcctctatctggcctcccacccacaatatgcagagccgggagcagaggctgccttttctggccgttttgctgagctcttcctgcagcacttcgaagctgaggtggctcgggcctcgggctcactctccccacctgtcttggctccattgagccctggtgtggaaatcccaccatcacatgacctgtcccttgagagctgcagggtgggtgggcccctggcagtgttgggcccttctcgatcttctgaggacctggctggcccccttccttcctcagtctcttcctctacaacgtcctcaaagccgaagctcaagaaacgcttctccctccgctcggtgggtcgttcagtcagaggttctgtccgaggcatcctgcagtggcggggggctgttgaatctccctcccaagctgggcctctggagaccacatcaggtcctccagttctaggtggaaacagcaactccaactcctctggtggtgctgggacagttggtaaggcattggccaacgatggcacatcccctggggagagatggactcatcgctttgagaggctaaggctaagtcgtggagggggaaccttgagagacggagcaggagtgatacagagagaagagctgctgagtttcatgggggctgaagaggctgcccctgacccagcaggagtaggtcgtggaggaggggcagctgggctgacctcgggaggaggagggcagcctcagtggcagaaatgtcgattactgctccggagtgaaggagaaggaggaggaggaagtcgcttggagttctttgtaccacccaaggcatcccggccccgtcttagcattccctgttctactattactgatgtccgcacagccacagccctggagatgcctgacagggagaacacgtttgtggttaaggtagaaggcccttcagagtacatcctggagacaactgatgcacttcatgtgaaggcctgggtgtctgacatccaagagtgcctaagcccaggaccctgccctgctatcagcccccgtcccatgacccttcccctggcccctgggacctccttcctcacaaaggataacacagagagcctggagttgccctgcctgaatcattcagagagtctgcctagccaggatcttcttctgggacccagcgagagtaacgaccgcctgtcgcagggagcttatggaggcctctcagaccggccgtcagcgtccttctcccctagttctgcctccattgctgcttcccattttgactcaatggaactgcttcctccagagttgccccctcggattcccattgaggaggggcctccagcagggacagttcatcccctctctaccccgtaccctcccctggatactcctgaagcagccacagggtcattcctctttcaaggggaggcagaggggggtgagggggaccagcccctctcaggctacccttggttccacggcatgctctctcggctcaaagctgcccagttagtgttagaaggaggtaccagctcccatggtgtcttcttggtacgccagagtgagacaagacgtggtgaatatgtcctcactttcaacttccagggcaaggctaagcacctgcgtttgtcactaaatgaggagggtcagtgccgggtccaacatctgtggttccagtccattttcgatatgcttgagcacttccgggtgcaccccatccctctggagtctggaggctccagtgatgttgtccttgtcagctatgtgccctcccagcggcagcagggccgggagcaggctgggagccatgcaggggtgtgcgagggcgaccgatgctaccccgatgcttcttccaccttcctgcccttcggagcgagtgactgtgtaacggagcacttcccgtgatccaacccagccttctgaaccccctccatggacagatcccccacatcctggggcagaagaggcgtcgggggcgccagaagtggcggcagccacagccgcagcagccaaagagaggcaagagaaggagaaagcgggcggcggaggggtccaggaagagctggtccccatggctgagctggtccccatggctgaattggaagaggccatagcaccaggcactgaggctcagggtggtgctggctctagtggggacttggaggtgtccctaatggttcagctccagcagttaccactagggggcaacggagaagaagggggtcacccccgagccattaataaccagtactcatttgtctgaga

SEQ ID NO: 4225 - DNA, 1439 bp, Rattus norvegicus
  Genbank Accession No. NM_134468
ctttagagccaggtacggacgcggcgggagctccgcaccagccacctaggccctcgctgccagccccgtggcggggcagccgcaggagccctggctgtggctggggggcagtgggccatgccaggggcagtggaaggccccaggtggaagcaggcagaagacattagggatatttatgacttcagggatgttctgggcacgggtgccttctcagaagtgatcctggcagaggacaagaggactcagaaactggtggccatcaaatgcattgccaagaaggccctggagggcaaagaaggcagcatggagaatgagatcgccgtcttacacaagatcaagcaccccaacattgtagccctggatgacatctatgagagtgggggccacctctacctcatcatgcagctggtttcaggtggagagctgtttgaccgaattgtggagaaaggattctacacagaacgggatgccagccgcctcatcttccaggtgctggatgctgtcaagtacctgcacgacctgggcattgtgcaccgggatctcaagccagagaacctgctatactacagtctggatgaagactccaaaatcatgatctctgactttggcctctccaagatggaggacccaggcagtgtgctctccacagcctgtgggactccaggatatgtggcccctgaggtcctggcccagaagccctacagcaaggccgtggactgctggtccataggagtcattgcctatatactgctctgtggctacccgccgttctatgatgaaaatgatgccaaactttttgaacagattttgaaggctgagtatgagtttgactctccttattgggacgacatctctgactctgccaaagatttcatacgtcatttgatggagaaagacccagagaagaggttcacctgtgagcaggccttgcagcacccctggattgcaggagacacagctctggataagaatatccaccagtcagtgagtgagcagatcaagaagaactttgccaagagcaagtggaagcaagctttcaatgctaccgctgtggttcggcacatgaggaagctgcagctgggcaccagccaggagggacagggacagacagctagccacggagagctgctgacacccacagctggggggccagcagctggctgctgctgtcgagactgctgtgtggagccaggctcagaactgccccctgcaccacccccaagctctagggccatggactgaacatcaaggagtcagggtttcgtccgtgaggggttggaggcagcctgcttcctcctcaccccagaactggggagtttctgaccccatacttcttccctcccctctcactcttcactgcattttccatacaaatgtttctattttattgttccttcttgtaataaagggaagataaaacaaaacagttaaaaaaaaaa

SEQ ID NO: 4226 - DNA, 912 bp, Rattus norvegicus
  Genbank Accession No. NM_138502
atgcctgaggcaagttcacccaggcgaactccacagaacgtcccctaccaggaccttcctcacctggtcaatgcggatggacagtacctcttttgtaggtactggaagcccagtggcacacccaaggccctcatcttcgtgtcccatggagctggggaacactgtggccgttatgacgagctggctcagatgttgaagaggctggacatgctggtgtttgcccatgaccatgttggccatgggcagagcgagggagagaggatggtggtatcggacttccaagtttttgtcagagatttgttgcagcacgtgaacaccgtccagaaggactaccccgaggtccccgtcttcctcctgggccactccatgggcggtgccatctccatcctagcagctgcagagagaccaacccacttttctggcatgatcctaatttcacctctgatccttgccaatccggaatctgcatcgactttgaaggtccttgctgccaaactgctcaattttgtcctgccaaacatatccttggggcgcatcgactccagcgtgctgtctcggaacaagtcggaggttgacctgtacaactccgacccactcatctgccacgcaggggtgaaggtatgctttggcatccagctgctgaacgctgtctcgagggtggagcgagcaatgcccaggctgacactgccgttcctgctgctgcagggttctgctgaccggctttgcgacagcaaaggtgcctacctgctcatggaatcatccccgagtcaggacaaaacactcaagatgtatgaaggtgcctaccatgttctccacaaggagcttccggaagtgaccaactctgtcctccatgaaataaatacgtgggtgtctcacaggatagcagtggcaggagctaggtgtctaccctga

SEQ ID NO: 4227 - DNA, 2004 bp, Rattus norvegicus
  Genbank Accession No. NM_138504
gacagcttctgggatccccagggctaatgggcatcctgttcttgcagcagggcactgtgagaaagtctctcaccgtgaccaagtttctctgagtgtccagccaacccaggctcaccagctccctccagctaccgcccgtccatcaggtcagctgccaaccccaggctgaacaccaaccccagctatgagctcctggaggcatgactccctcagggccagcagctccgatcccctcccagtagttatcattggcaatggtccctcgggtatctgtctatcctacctgctctctggctacatcccctatgtgaaaccaggagctgtccacccgcaccccctgctgcagaggaagctgaccgaggctccaggggtctccatcttggatcaggacctagaatacctttccgaaggcctcgaaggccgaagccagagtcctgtggccctgctctttgatgccctcctacgtcctgacacagactttggaggcagcctagactctgtgctctcctggaagcggcagaaggaccgtgccattccccaccttgtcctgggacggaacctccccgggggtgcctggcattccattgaaggctccatggtgactttgagccaaggccagtggatgagtctcccagacctgcaggtcaaggactggatgcggaagaaatgcagaggcctccgtaacagcagagccacagccggtgacatcgcccactactacagggactatgtgatcaagaagggtctcagtcacaactttgtgtctggtgccgtggtcactgccgtggaatgggctaagtctgagcactgcagccctgaggcccaggcgcccagccccctcttccaagtgacaggctacctgactgccaaggaccacagccgccagcccttctcactgtgggcccataacgtggtcctggccacgggcacctttgacagcccagccatgctaggcatcccgggagagaccctgccttttgtccaccacgagctgtcagccctggaggcggccctccgggcaggcactgtgaacccaacctcagacccggtgctgattgtgggagctgggctatctgcggccgacgctgtcctctttgcccgtcactacaacatccaggtgatccatgcctttcgccggtctgtgcacgaccctggcctggtgttcaaccagctgcccaagatgctgtaccccgagtaccacaaagtgcagcagatgatgcgtgaccagtccatcttgtcccccagcccctacgagggctaccgcagcctcccagagcaccagccactgctcttcaaggaagaccgtcaggcagtgttccaggacccacaggggggccagcagctctttggagtctccatggtgctcgtcctcatcggctcccaccccgacctctcctacctccctagggcaggggctgacctggccatagaccccagtcagccactgagccccaagaggaaccccatcgatgtggaccccttcacccatgagagcactcaacaggagggcctgtatgccctagggcccctggctggggacaactttgtgaggttcgtccagggtggagccctggctgctgccagctccctgctgaagaaggagaccaggaagccaccttaacactagcctgatgccctgacacccaatccctgaggaggaagagggctcaccatagcccagtggcacatgagcccgcctaaagattttccatgcggggaccagtctcccctgcaggaggggaagacttgagccccgtggatgggggactatctgccccagaggtatggggaacacaggccgccctatcctcaggcgagtcaaggcccaaggtgggagcagtagccatagaccagaggggcctgggacccctgaagctgtcggtgtgtgctggagtcacagggccagctgagtgtccaactaggaagacctcagacctaacctttcaccatcagatctgcaataaaaccagctgtgcctccactgcaaaaaaaaaaaaaaaaaaa

SEQ ID NO: 4228 - DNA, 2599 bp, Rattus norvegicus
  Genbank Accession No. NM_138508
taaagcttcagtctgtaggaggttgttctctttgctgctagagccatgccttcagtcgcgttgaactctccgcgcctgcgccgggtgttcgtggtgggagttggcatgaccaagttcatgaagcctggaggtgagaattcaagagactatcctgatttggcaaaagaagcaggccagaaggcattggcggacgcgcagatcccttactccgcagtggagcaggcgtgcgttggctatgtgtacggtgaatccacctgcgggcagagggccatctatcacagcctggggctgactggcatccctatcattaatgtcaacaataactgctctaccggttctactgctttgtttatggcccagcaactggttcagggaggtttagcaaattgcgtgttagctcttgggtttgagaagatggaaaagggatcccttggtaccaaatattcagatcggtcaaatccactggaaaaacatattgacgtcttgatcaataagtatggaatgtctgcctgtccatttgctcctcagctgtttgggagcgctgggaaagaacatatggaaacatatggaacaaaggttgaacactttgcaaaaattggatggaaaaatcataaacactcagttaataacccgtattcccagttccaagatgaatacagcttagatgagataatgaaatcaaggccagttttcgattttctgactgtcttacaatgctgtcccacctcagatggtgccgcagcagcaattgtgtctagtgaggagtttgtgcagaagcatggcctgcagtccaaagctgtggaaattgtggcacaggagatggtgactgacatgcccagtacatttgaagaaaaaagtgttattaaaatggttggctatgatatgagtaaagaagctgccaggaagtgctatgagaagtccggcctgggtcccagtgatgtcgacgtgatagagcttcacgattgcttctctaccaatgaactcctgacttacgaagcactggggctctgtccagaaggacaaggtggagcactggtggacagaggggacaacacttacggaggaaagtgggtcataaaccctagtggaggcctcatctccaagggacacccactgggtgccacaggtctggctcagtgcgcggagctctgctggcagctgagaggcgaagccggaaagaggcaggttcctggggcaaaggtggctctgcagcacaatttaggccttggaggagctgctgttgtcaccctctacagaatgggttttcccgaagctgccagctccttcagaacgcaccagatttcagctgctcccaccagctctgcaggggatggattcaaggcaaatctcatttttaaggaaatcgagaagaagcttgaagaggaaggggaagagttcgtgaagaaaatcggtggcatttttgccttcaaagtgaaggatggccccgggggcaaagaagctacgtgggtggtggacgtgaagaacggcaaaggatcggtgcttccggattcagataagaaggctgactgcacaatcaccatggctgactcagacttgctggctttgatgactggtaaaatgaaccctcagtcggccttttttcaaggtaaactgaaaattgccggtaacatgggcctggccatgaaactgcaaagcctgcagcttcagccggacaaagctaagctgtgaagagtccctttggcaacctcaggacatcaagatgagatgtgtggatacgtagaaatccacgtctccctgtcaggacttagactgacacttcctgaatagcatgagatagatttcttgctaggtggctatggccaattgtatttcccccaagctgggggtgcaaagggcctcccaggctacactgctgctttgaggacttgcattctactgtgcttcatgaagctactatgttaatgatggtttggggtaaacttgagtttcagaataaagttcagaatagtaaaatctaaagactgtgtaaacagagcccttgttttgcttagaagtacatttaaggatcgtcgtgttggacactcggtgtgacagtttccccttagagggactggagaagaaacagatttccagagttgaccaggaattagtgcctcacacttaattacctgcatcagtttctcactaatagttcttaaaataaaattctgtactgagtgtttaaaaaaaaactttaaaaatgttcttttcatgccatcagaaacagttcttttcttcccaaataaaatacaagaattatggtcagagcttaagagagaatttacagctgaacagagctgtttttaaaatatttttaaagtgggcatcttttaaaaaaaatcagcatcggagctatgggatgccattgctaaaaataattgaataaagtttcttccagagatacaggcttcaaattatattttcatactagtaagtttataaactgggtctcacaaatttcctctttcatgcatttggttgtctgcatttatctttcttcctggtttttctaactctaacgctgtttgttataatttaggtttgggataaaaatatgcttttggaagatttaaaaagaaaattaaaacagctcttcctg

SEQ ID NO: 4229 - DNA, 1215 bp, Rattus norvegicus
  Genbank Accession No. NM_138510
ggcacgagagaaagcgactcttctagggaagagcagcatctgagaatgaattccaaaattcagaagatggagttaaacgatggtcactccatccctgtactgggctttggcacctatgcaaccgaagagaatctcagaaaaaagtctatggagtccacgaaaatagctatagatgttgggttccgccatattgattgttctcacttgtaccagaatgaagaagagataggtcaggccattgtaagcaagattgaagatggcactgtgaaaagggaagatatattctatacttcaaagctttggtcaacttcccatcgtccagagttggtcagacccagcttggaaaattcactgaggaaacttaatttggactatgtagacctctatctcattcatttcccggtatctctgaagccaggggatgagcttttacctcaagatgagcatggaaacttaatacttgacacagtggatctctgcgacacctgggaggccatggagaagtgtaaggatgcaggattggccaagtccatcggggtgtccaactttaaccgcaggcagctggagaagatcctgaataagccggggctcaagcacaggcctgtgtgcaaccaggtagaatgccatctttatctcaaccagagcaagctgctcgcttactgcaagatgaatgacatcgttctggttgcctatggtgccctgggaactcagagatacaaatactgtattaatgaagataccccagttctcttggatgatcccattctttgtaccatggcaaagaagtacaagcggactccagccctgattgcccttcgctaccagctggagcgtgggattgtgaccctagtcaagagtttcaatgaggagagaatcagagagaacctgcaggtctttgatttccagttggcttcagatgacatggaaattttagataacctggacagaaatcttcggtactttcctgctaatatgtttaaggctcaccctaactttccattctctgatgaatactaagatggcagccctagccatgagttctgctcgaagctcctttgtgtgatgctcgactctcagaggccaataatacaacacactgactccaatccatactgcttagcaactcacccccagtttgagctgtgtctgtacatcggggagcaaattcactaaattttcctgcttttctgtaaataaataaaaatattttgcttc

SEQ ID NO: 4230 - DNA, 1715 bp, Rattus norvegicus
  Genbank Accession No. NM_138512
gaaaaagaaaaaccaacaagaaagccaatggctctcttcatttttctggggatttggctttcttgtttggtttttctttttctatggaatcagcaccatgtcagaaggaagctcccacctggtcccactcctctaccaatttttggcaatattttgcaagtgggtgttaaaaatatgagcaaatctatgtgcatgctagcaaaagagtacgggcctgtgttcaccatgtatctgggcatgaagcccactgtggtgctgtatggatatgaagtattgaaagaagctctgattgaccggggagaagagttttctgataaaatgcattcgtcaatgctcagtaaagtcagccaagggttaggcattgtcttcagcaatggagaaatatggaaacaaacacggcgtttctccctcatggtcttaaggtctatggggatgggaaagagaactattgaaaaccgaattcaggaggaagttgtttatctgctggaagcactgagaaaaaccaatgggtccccgtgtgaccccagcttccttctggcctgtgttccctgcaatctgatctccagtgtcattttccagcaccgttttgactacagtgatgagaaattccaaaaattcatagagaatttccatacaaaaattgaaattttagcatctccttgggcccagttgtgcagtgcctatcctgttctatactatctcccgggaatccataacaaattcttaaaagatgtgactgaacagaaaaagttcatcttgatggaaataaacaggcatcgagcatctctgaacctcagtaaccctcaggactttattgactatttcctgattaaaatggaaaaggaaaaacacaatgaaaagtctgaatttaccatggacaacctgatagtcaccataggtgatctttttggagcaggaacagagacaacgagttccaccataaaatatgggcttttgctcttgctgaagtacccagaggtcacagctaaaattcaggaagaaattactcgcgtgattggtagacaccggagaccctgcatgcaggacaggaaccacatgccctatacggatgctgtgctgcatgagatccagagatacattgattttgttcccattcccttgcctcgtaagacaacgcaggatgtggagttcagaggataccacattcccaagggcacaagcgtaatggcatgtctgacttctgccctgcacgatgacaaagaatttcccaacccagagaagttcgaccctggccactttctcgatgagaaaggcaacttcaagaagagtgactacttcatggctttctcagcaggaagaagagcctgtattggagaaggtttagcccgcatggagatgttcttaatcctgaccagcattttacagcattttattttaaaacctcttgtcaatccagaggacatcgacacaaccccagttcaacctggtttattgtctctgcccccaccctttcagctctgtttcattccagtctgaagcggcatagtctttcacacagatgactgagaccctgcttctacttgtgagcaaacaggtcctcctgtcctcgtgtacctgtaactggcagtccttcctgaatggcagggatgctacctctgaactgtcctacatttttttcaattctttgtgaaccagttccaatttttcatatgtgaaaaaacttcactgttttagcactaataaagttttttttc

SEQ ID NO: 4231 - DNA, 2746 bp, Rattus norvegicus
  Genbank Accession No. NM_138515
gctcctcacagctccccctccacctctgagtggatcctcctctgagtttctcttcttcctcagagctcctcctcctcccggtcctgcaaggctccagacttctcgacttggtttcagaaagcaccggtggctgtagtcgggattgagaggtgtttccaaagaaacccaaagagcagcagggcagccatgaggatgccgacggggtctgaactgtggcccatagccatattcacgatcatcttcctgcttctggtggacctgatgcacaggcgccagcgctggacttctcgctaccctccgggccctgtgccctggcctgtgctgggcaacctgctgcagatagacttccagaatatgccagcgggctttcaaaagctgagatgtcgctttggggacctgttcagcttacagctggcctttgagtcggtggttgtactgaatgggctgccagccctgcgagaggcactggtgaaatacagcgaggacaccgctgaccggccaccgctgcatttcaatgaccagtcgggctttggaccacgctctcaaggtgtggtcctcgcgaggtatggacctgcctggcgtcagcagcggcgcttctctgtgtccaccttccgtcactttggcctgggcaagaagtcactggagcagtgggtgacagaggaggccagatgcctctgtgctgccttcgctgaccatagtggattccctttcagccctaacactctactggacaaagcagtgtgtaacgtgatcgcgtccctcctctttgcctgccgctttgaatacaatgacccacgcttcatcaggctcctggacttgctgaaggacactcttgaggaggaatctggattcctgcccatgctcctgaatgtgttcccgatgctcctacacatcccagggcttcttggcaaggtattctctggaaagaaggccttcgttgccatgctggacgagctgctaactgaacacaaggtgacctgggaccctgcgcagccaccccgagatctgactgatgccttcctggctgaggtggagaaggccaaggggaatcctgagagcagcttcaatgatgagaacctgcgtgtggtggtggctgacctgttcatggcggggatggtgaccacctccaccacactgacctgggccctgctgttcatgatcctgcgtccagatgtgcagtgccgagtacaacaggaaatcgatgaggtcatagggcaggtgcggcgtccagagatggcagaccaggcacgaatgccgttcaccaatgctgtcatccatgaggtgcagcgctttgcagacattctccctcttggtgtgcctcacaagacttctcgtgacattgaagtgcagggcttccttatccctaaggggacgaccctcatcatcaacctgtcctcagtgctgaaggatgagactgtctgggagaagcccctccgcttccaccctgaacacttcctggatgcccagggcaactttgtgaagcatgaggccttcatgccattctcagcaggccgcagagcatgcctgggggagcccctggcccgcatggagctcttcctcttcttcacctgcctcctgcagcgcttcagcttctccgtgcccgctgggcagccccggcccagcaactatggcgtctttggtgctctgaccaccccgcgcccctaccagctctgtgcttcaccccgctaaggggaggcacagcatctcactcactgtgcttgctggggtcctagtgtgcaataaatggttttactctgaaccgaatcatccctgtgagctctccaggctgtaaggggcctgagcagccttcccgtggacatccgcacccctacttaatcttccttgaccatgtgccccaatggaagggctgctctactgacctccgaaatggcagccattcttgctttcacccctgccccctcttttcacccaaattgatgatgtttattcatagatgccaacatctggaaggagggccagaaaggactgctgtgaagggtcagtgtaagtcacacagatgagggaaggggcggtggaggtaatggtgggcagaattgtcccctttccacttgagatgtttctcccagacgcccccatttcagacccactacacaaccaaggctaactcctcagccagcatcatcacaacttcttatatgacgtcgcagagatgtagagaagtcggggaggctggaaatgacatgcaggttaagtgcccaaggttacctgttgggtaccacatgcttccctaaacggttttgtgggggtccagaagcaggttgcctcctaagcttctttgtcaccattaattccatgacccagcagggatactggtgtccaggcccatgcacagtaagaaagtgactctaaccagggatggaaggacccgcaagcttagtgttgacacagactcccagaccttagcacaactgactccatggtagaagtaccatttgggccataaaacttagcacgtagacagcagctcctctcataatgaaaacaaagacctaacccatcaaattctatcctgggaaggtctcttgaagcactcctcttggcttcttggcttctgtagttctcctagctaactgctcttgctaactgaagtatgtcaacccaggatatggttgttggtaaaagctcgccctgagaacagctcaggacgacattgaggtgacccagtgtagtcaccagccagctaataaagacctccttttggtttaaaaaaaaaaaaaaaaaaaaa

SEQ ID NO: 4232 - DNA, 925 bp, Rattus norvegicus
  Genbank Accession No. NM_138517
tcttctagagctgaaaagagagcaaggacaacactctcgacggtgggacctaggtggccttccagggaagatgaacctcctcttgctcctgctgaccgtctctctggcccccacgacagaggcagcggagatcatcgggggacatgaagccgatccccactctcgaccctacatggcctatcttcagtacaagaatgaggattctcgggatacaatatgtggtggtttccttatacgagaggactttgtgctgactgctgctcactgttcagggagcaaaataaatgtcacattgggggcccacaacatcaaagaacaggagaagacgcagcaagtcatccctgtggtgaaaatcattccacacccagcgtataatgctaagacaatctccaatgacatcatgctattaaagctgaagagtaaggccaagaggactagagctgtgaagactctcagtctgcccagaagcaacttcaaagtgaagccaggagatgtgtgctatgtggctggttggggaaagctgggcccaatgggcaaattcccagacaaactgcaagaggttgagctaacagtacaggaggatcaggagtgtgagacttacttaaaaaatgcttacgacaaagccaatcagatatgtgcgggggacccaaagatcaaatgtgcttcctttcagggggactctggagggcctcttgtgtgtaaaaaagtggccgcaggcatcgtctcctatggacgtaaagatggttcaactccacgggcattcaccaaagtctcgactttcctatcctggatagaggaaactatgaaaaagagctaactacaagatgcaacgtggatcatttcctgactaaccaccttccctatagctgagtccaggattgctctaggatagatggcagcaactgaataaagcattttttctgac

SEQ ID NO: 4233 - DNA, 1845 bp, Rattus norvegicus
  Genbank Accession No. NM_138523
ggcacgaggtggtagttcgtcctctaccccctcccctagcgggtgaggttacagcgacgggctggagaggcaaagtggagttaagacactgggatccagatggacatcctgaagtcagagattctgcggaagcggcagctggtggaggacaggaacctgctggtggaaaataaaaagtacttcaagcggagtgaacttgcaaaaaaggaagaggaagcttattttgaaagatgtggctacaaggtacagccaaaagaggatgaccagaaaccactaacgtcatcaaatccagtgctggaacttgaactagcagaggaaaagcttcctatgactctttctaggcaagaggtcatcagaagactgagagagagaggagagccaatgaggctgtttggggaaactgactatgatgctttccagcgtttaagaaaaatagagattctcacaccagaagttaacaagggcttaaggaatgacctaaaagcggctctggacaagattgaccagcagtacttgaatgaaatcgtgggtggtcaggaacctggagaggaggacacacagaatgatctgaaggttcacgaggaaaacaccaccattgaggagttagaggcactgggggagtccttagggaaaggtgacgatcacaaggacatggacatcatcaccaagttcctgaagtttcttcttggtgtttgggctaaagaattgaattccagagaggattacgtgaaacgcagcgtgcagggcaaactgaacagtgctacccagaagcagaccgagtcctacctcagaccacttttcagaaagctccggaaaaggaatcttcctgctgatattaaagaatcaataacagatattattaagttcatgctacagagagagtacgtgaaggcgaatgacgcttaccttcagatggccattggcaatgctccctggcctattggtgtcactatggtcggcatccacgccagaactggcagggaaaagattttttccaagcatgttgcccatgtcttaaatgatgaaacccaacgaaaatacattcagggactgaagaggttaatgacaatctgccagaagcactttcctacagacccgtccaagtgtgtggagtacaatgcactgtaaggtgctgtaaagtctgagcacggtgtgtaacaggcgcctctccgcggcccgcagcccacagcccttagccctctgacttccagccttaccatggcgacgagggaggagctgcagggtgccgctccaccgggtgcacttcctgttaacttcaaaaactggggtgcctttcacatggtattggactgcaaactaattttcgtgtcttgatttaattttaatcagttgaaaattaagttctaaaaatgttatctgggtttttttttttttcctttggaacaatttcaaactttattgtcaagatagcagaagcttagttcacaagaatcagcagtagttggtgatctacttgcaaacacctttttttttttttttttggtgcatttctctctacaccatcatgagagaggaagaccagcaaagagtagcaaagtgaactgacaccacacagggctgcccaccgtctactgggctatatttataccctttccaaatatcgtgctttctctcggtcaagtttttcataaccgaaattaaaaagctgtgtacaaattaaagaagctgtatggaaactgctaggacatgttgaaaatgatctttccttcaagccatggacatttacttctgcatagactatatattttaaaacaataaagacataactttccttttaaacagtaaaaaaaaaaaaaaaaaaaaaaaaaaaaaaaaaaaaaaaaa

SEQ ID NO: 4234 - DNA, 1263 bp, Rattus norvegicus
  Genbank Accession No. NM_138530
gccagtgaggaagatgaagctcccgattttcatagcagatgcgttcacagtgacggctttccgaggtaatcctgccgcagtctgcctgctggagagcatactccaggaagacgcccatcagcaaattgcgagggaaatgaacctctcagaaacggctttcatccggaaactgcagccgacggacagcttctcacaaagttcttgctttggactaaggtggtttacgccagtgagtgaagtccccttgtgtggccacgccaggatggcctctgcggctgtgctgtttcacaaaataaagaacgtgaacagcaccctgacctttgtcactctgagcggggaactaaaggccagaagagcagaagacgggattgtcctggactttcctctctacccaaccttcccccaggacttccatgaagttaaagacttgataaaggcagccataggtgacactacagtccaggacatccagtattctccagatacccgaaaactcctggtccggctcagcgattcttatgacaggtcctttctagagagcctgaaggtgaacacagagcctctgcctggaattgagaagacaggaaaggtgaaaggcctcatcctcactgtcaaaggagagtctggggggcaaacaaccccatatgacttctactccagatactttgcgcctcgggttggtgtacctgaagacccggtaacaggatctgcacacaccgttctcagcagttactggtcccagcaggtggggaagaaagagatgcgagcctttcagtgttcctgccgaggaggggagctggacatttccctgcgacctgatgggcgggttgacatgaaaggcggagccgctgttgtcttggagggcatgctgacagcctagagatgcttatgctgggcttgcagctcaactcttctctacagccaagaacccaacccaacccaaccaaaccagcaccaagtggtgccctcagtcctctcgtgaagaccagagaagggaagacatttgatggaggtgctgaatcctctcctgattctccagaatcctctcctggtggtgggctccgggctctgcctgtgtatgcatcttcagtccctatagcagacacggatgctgtcccttcttttgattatgactgccaaagcaagagatgcattgataaggagccagatgaagccatttcaatcccagttgggtaccttagggtatttcacagccttgtagaagaataaatatctgtgtagaaaaaaaaaaaaaaaaaaaaa

SEQ ID NO: 4235 - DNA, 5433 bp, Rattus norvegicus
  Genbank Accession No. NM_138535
caggcagcaacagccggtggcacagcacagaagccgcctctgctgatagagaatggcccgcagcccgggtgagcctgctgtagccttctccctgactcagactccaccccatccctggctcagctgagtgtcagcggggccttctgcttcccctggaggcaggcaggacctgaccagactgtcctgggaagtgacgatgggccttactcaaaggggggaaaggacacagcggggactgatggggccctggtgtgccgccgccagagcattccagaggagttccggggcatcaccatggtggagctgatcaagcgtgagggcagcactctgggcctgactatctcaggagggactgacaaggacgggaagcccagagtctccaacctgagacccgggggccttgcagccaggagcgatctactgaatgtgggcgactatatccgctcagtgaatgggatccgtctgacccggctccgacatgacgagatcatcacattgctgaagaatgtgggcgagcgcgtggtgctggaggtggagtatgagctgcccccgcccgctcccgaaaacaacccgaggatcatttccaagacggtggacgtctccctctacaaggaaggcaacagttttggctttgtcctcagaggaggtgcccatgaggacctgcacaaatcccgcccattggtcctgacttacgtgcggcctggtggcccagcagacagggagggttccttaaaggtgggcgacaggctgctcagcatagatgggatcccactgcacggggccagccatgctaccgcaatagccaccctgcagcagtgcagccatgaggccctcttccaggtggagtacgatgtggccaccccagacacggtggccaatgcttcaggccctttggtggtagaaatagccaagaccccaggatctgccctggggatctctctcaccactggctcccaccggaacaaaccagctatcactatcgaccgcatcaagccggctagcgtggtggacaggagtggtgccctgcatgctggagaccacatcctggccatcgatggcaccagcacagaacactgctctctggtcgaggccacgaagctcttggccagtgtgaccgagaaagttcgactggagatcttgcctgcaccccagagtcggcggcccctgaagcccccagaggcagtgagaatacagaggagtgagcaactgcaccactgggacccctgtgttccctcttgccatagcccaaggccaagccactgcagggcacccacctgggcacctggaggccaggaccagagccgatccgtgtcctcgactcccttctcctcgccaactatgaaccctgcctttccctgtgccaacgccagcaccctgcccagaggacccatgagccccagaacaacagcggggaggagaaggcagcgaaggaaagaacacaggagctctttgtcactggcctccagcacggtagggcccggtgggcagatcgttcacacggagacgacggaggtagtgctctgtggagaccccctcagtggcttcggcctccagctgcaggggggcatttttgctaccgagaccctgtcctccccacccttggtgcgatttattgaacctgacagccctgctgagaggtgtggtctgctgcaggtgggggaccgcgtcctagccataaatggcattgctactgaggatgggaccatggaggaagccaaccagctgttgcgggatgctgcactggcccgcaaagttgttttggagatcgagtttgatgtggcggagtctgtcatcccaagcagtgggaccttccacgtgaagttacccaaaaggcgtggtgtggagctgggcatcaccattagctcggccagcagaaagcgaggggaacccctgatcatctctgacatcaagaaaggcagcgtggcgcacaggactggcaccctcgagccgggcgacaagctgctggccattgacaatattcgcctggaccattgccccatggagtatgctgtgcaaatcctgcgccaatgtgaggacctggtgaagctgaagatccggaaggacgaggacaactcagatgagcaggagagctcgggcgcagtcagctacacagtggaactgaagcgctatggcggacccctgggtatcaccatctccggtacagaggaaccttttgaccccatcatcatctctggtctcaccaagcggggtctggctgaaaggactggagccatccatgttggggaccgcatactggccatcaacagcgtgagcctcaagggccggcccctgagtgaggccattcaccttctgcaggtggcaggggagactgtcacactgaagatcaagaagcagctggaccgtccccttctcccccgccagtcaggcagcctcagtgaggccagtgatgtggatgaggacccccctgaggccctcaagggaggcttgctgacaacccacttctcacctgctgtacccagcgtggacagtgctgtggagtcctggggcagctctgccacagagggtggctttgggggctcaggctcctacactccgcaggtggcagtccggagtgtgactcctcaggagtggcgttccagcagactgaagagtagccccccaccccttgagccccggaggacgagctacacaccgggccccactgacgaaagcttcccagaggaggaagagggggactgggagccaccaatgaggcatcctgtgtcaccgctctccaccccgtctcatctgcccctgttctaattggctaccaacagtcttggtcgcccctaactgcgtcttccccaccccattctgtgtcaccaaccactgcccagcactgggccctgggcaacgaagactcctcaggcccagcccacccaccctcccacctgccaggagttgacgctgtggttcctgttgcagcccagcccctggccccgcccgagaggagggcttctggagagtgcttggagaggcccttgaagacctggagtcctgtggtcagtctgaactgctaagggagctggaggcttccatcatgacaggcactgtacagtcggtagctgtggatggcaggcctggctctcggccctggcgccggagccgggaagtcggaacatccccggaagacctgcaggagctgctgttgccaacgcccctggagatgcacagggtgaccctgcacaaagacccggtgaggaacgactttggtttcagtgtctcagatggcctcctggagaagggtgtctatgtccacatgtgcgcattgatgggccagctcagcacggaggcctgcagccctttgaccgtctcctgcaggtcaaccatgttcgcactgggacttcgattgctgtctggccgttccactactggcagaggtggggacatccttgagctggtggtcagccgaaaccatctggcacagagccgcagacaccagagcaccgggccccagtagtccccagatgatctgaggtcattatgtaagtcagctggcggagtgcccccagtcatcgattatggcctgcagattcacatccggtagagtggcatcttcaagttgggtcttcaggatgctcagagaaccccacaggaaaggggtcatccctgctgctcagctaggagagcccagctccctgtgcagtcatctcagagcagcgaacagagtggggacggcccactccgtgtggtaatggatgatgccagtatttcccattgggaagttaataagctgtaggtcgacaattctgctctgtggaaagaggcatttggcgacccagctgttcagatggtacccagtgcacagggaccctgccaccgggaaagatatggcacaagaacagtgtcctcccttctcccaaatggtggtgttttgagagcctccagcacctagtgaccatactgaggaaccccaattagggacaatctagggtgccagagaatgcttgccccttcctttgggttggtctttcaattatttcacgggtgattctgaacctcagagcagaactgtggccatcaaccctcctgtcccacaaaaccttagcccaagtccttgcccagaggagggcacagctcgggtcaaacggtccaggagcatccacacacctgccattccagcacatatggtaaaccttgggaagagactgagccacagttctgcccctgaccccatcagaggaagagaggaagaggaaaggagctgacatggagggaggtcagctgaaggatgagagagtggctaactggagcagtgtccaaggaggctattcaaggaggtccccagcatcccttaactctgggctcctccatctctgctaagcagaacccttccagcttcaagcaagactcaagacacttccttcccagcagtctgagctgttctggagactggcttcatgtttgcccagcttaaggtctcaaggacctgcgggaagcctccaaccctgccctgtcacccctctgtgcccttgaagctcactgctagaaagcactccctgttcaagaggacagatgaggtcccagaagccattctttccccgttctcttcttggctgtataaccttgagtaaagctgaaaagacacagggcgagctccagctgcccactaagacacttcagctctctgcttttcctagcttcccccatatcctgcccttcatgatggcttccccagggacccttcaggcaacccagtgactctactttcactgccccagggtagaaagatactacccacccatcatgggcaccaaacaaagaccttcagcttcactagcagagaagtgactcctagccaccagctcacctgatcctgtgtgaccttgggcagatggctcagcctctggatttctggtgtgtggcataactgactgtaccctgaaggcctcttagcttgggaaatctgtgttccacttaatgactccaggctctgaaaatgcaacccctcgaccactgccctcccctcgggctgaggctctcccatcctcccagacgtatgcaactaggccaagcgggtggacctcctggctgtggcctgaggccttctcatatgcaatatacccccctggcttctcacaggggtgtttgccccacacaacatccctagcccccaccccagtgagcatcctgcctgcctatgcattttgggtacctcccctgtgacacccacccccagagctgtatttttctctggctaagattagaacatattccttgtaaagtatttttctatgcgggttttcttagggctcccaggaagcacccagcacacccatggccccactgtacaggttgtttctggtctgtctggggcccacctataaatctttgtcccaccaggcatcacagtgactggggggaggttgagtgctattggggtgattttttttaaataaaattggttaaatgaaaaaaaaaaaaaaaaaaaaa

SEQ ID NO: 4236 - DNA, 2466 bp, Rattus norvegicus
  Genbank Accession No. NM_138547
tttaaatagtaagaaaaaattcacagacagaaaaatttttgttaccaggtggccataaagaggtttcttgcccacagtgaactgatagctgtgacccacgtgtggttcctatggcgtcttggaagtacctccaaccctgtgaaagtgcattcctcacacagggctgtctcagaacagtcagaagaccctcgccagacccaagacctgcttggttgcatgagtaacaagcgatggattccatatctctgcgtgtagcactaaatgatggtaacttcattcctgtactggggtttggaaccactgtgcctgagaaggttgctaaggatgaagttatcaaggctactaaaatagctatagataatggattccgccattttgactctgcttatttgtacgaagtagaagaggaagtgggccaagccattagaagcaagattgaagacggcactgtgaagagagaagatatattctatacttcaaagctttggagcactttccatagaccagagctggtccgaacttgcttggaaaagacactgaaaagcactcaactggactatgtggatctttatattattcatttcccaatggctttgcagcctggagatatatttttcccacgagatgagcatggaaaactattgtttgaaacagtggatatctgtgacacatgggaggccatggagaagtgtaaggatgcaggattggccaagtctattggggtgtccaactttaactgcaggcagctggagaggattctgaataagccagggctcaaatacaagcctgtgtgcaaccaggtggaatgtcacctttatctcaaccagagcaaaatgctggactattgtaagtcaaaagacatcattctggtttcctactgcacgctgggaagttcacgagacaaaacatgggtggatcagaaaagtccagttctcctagatgatccagttctttgtgccatagcaaagaagtacaagcaaaccccagccctagttgcccttcgctaccagctgcagcgtggggttgtgcccctgatcaggagtttcaacgcgaagcggatcaaagagctaacacaggtttttgaattccagttggcttcagaggacatgaaagccctggatggcttgaacagaaatttcagatacaacaatgcaaaatattttgatgaccatcccaatcatccatttactgatgaatagtaacatggtggactttgtcagcatttctatcggaagatctgtttatgcattgtgatttgaaagatatcttggatactggtgactgaatgcatcagaccactgtttctgttaattcacagtcagctggagcaatgtccacagtgctatgagggaagccatgtttttgtcacactctgaaatggaacatcacgttgcttttccttgtgtttttaaatattcatttattttgctttccatatatgaatattttccctacatgtatgtgtatctcatgaatgtctatgtccatgcagggttgaagagtgttgcaggtcacttggaaccggagttacattgattatggagttaccatgtgggtgctgggagccaaacctaggtcttctgtgagactagcaagtgcctttgaatgctgagccatctcattaggtccaaccctaaagatccttgcctgccactatttctgtgatctcaatgttttgttttctcctgacttctgacaccaagctgatttgctagaagtcttgggcatgaagtgggtgttgaggacagttattgcaaagggatttctgggtgggagttgaaagaacgttcaacattcagggaattaattgttcgaggttattgattagtcaatattccccatattctttgaggaagaagaaagtactccatagattttccctttttcttagttttgaggtagggcacctgtggcaggagtgaccaagagacccagggttctctccaacagcccaagaaccagagctccaagaacctggagagcaagttcttgtgggaaggttggaatgttggtaagaagagaaccaatctaaaagcatcatcatgattcagatgtggggagtttgagaggaaatttgaatgtgtctctctttttgggaaatatatcatcttttttctttttgtaattacatgttgggagcaatgcccttgaaaccctccattattgatgtaatggttagaattaagtatgactgggttcatggaaaatccccagccagctgcagaagactaatacaaatctggtggtcaggatgaataatgatatgataaagttctgaccttgctgagaaatacatctgacatcaagatacccaatgtgatgacctgtaagctttctgaaaaaccaacatcctgttgacatcagctgactacatgtatactgtgcccttggcctgtgtaaatgtttcacacttcccccctccctctgttacccatgttatggtataaattcagccttggtaaaaaa

SEQ ID NO: 4237 - DNA, 1178 bp, Rattus norvegicus
  Genbank Accession No. NM_138549
agaagggacgcacgcatagagaggggcggagccggagccctggagtgctgctccttgtgtgtgtggggctgggtggtggttggtgcggcagggcggctactcagctgcagcagtgcaggtgccatcctgtggaagaaccatgaagcactacgaggtggagattcgggatgcaaagacgagggagaagctgtgcttcctggacaaggtagagcctcaggccaccatttctgaaatcaagacccttttcaccaagacacacccgcagtggtatcctgcccgccagtccctccgcctggaccccaaggggaagtccctgaaagatgaagatgtgttgcagaagcttcctgtgggcaccacagctacgctctacttccgggacctcggggcccagatcagctgggtgacggtcttcctgacggagtatgctgggccccttttcatctacctgctcttctacttccgggtgcccttcatttatggccgcaaatacgactttacatccagtcggcatactgtggtgcacctcgcctgcatgtgccactccttccactacatcaagcgcctgctggagactctcttcgtgcaccgattctctcacggaaccatgcccctgcgaaacatcttcaaaaactgcacctactactggggctttgctgcgtggatggcttattacatcaaccaccctctctacacaccccctacctatggagttcagcaggttaagctggcactggccatttttgtgatctgtcagcttgggaacttctctatccacatggctctccgggatcttcgaccagcggggtcgaaaaccaggaagatcccataccccaccaagaaccccttcacctggctgtttctgttggtgtcctgtcccaactacacttacgaggtcggctcctggattggctttgccattatgacacagtgtgtcccagtggccctcttctccctggtgggcttcacccagatgactatctgggccaagggcaagcatcgcagctacctgaaggagttccgtgactacccacccctgcgcatgcccataatccccttcctgctctgagcagctcctcccgagctcagcccagtaatgccctccacctactacccctgtcctgatgtggctggccaaggctctccagcagcaacaataaaacctgcttacccaaaaaaaa

SEQ ID NO: 4238 - DNA, 996 bp, Rattus norvegicus
  Genbank Accession No. NM_138708
atgggcacacagcagaaggacgtcaccatcaagtcagatgcgcctgacaccctgctgctcgagaagcatgctgattatatcgcctcgtacggctcaaagaaagatgattatgaatactgcatgtccgaatacttgagaatgagcggcgtctactggggcctgacagtgatggacctcatggggcagcttcatcggatgaataaagaggagatactggtgtttatcaagtcgtgccagcatgagtgtgggggagtcagtgccagcatcgggcacgacccccaccttctctacacgctcagtgctgtccagattctcactctgtatgatagcatccatgtaatcaacgtagacaaagtggtagcctatgttcagagtctacagaaagaagatggttcctttgctggagacatctggggagaaatcgatacaagattctcattttgtgcagtggcaactttggctctcttgggcaaacttgatgctattaatgtggaaaaggccattgaatttgttttgtcctgtatgaactttgatggtggatttgggtgcagaccaggctctgaatctcacgccggacagatctattgttgcacaggattcctggccataactagtcagttgcatcaagtgaactccgacctacttggttggtggctttgtgaacgacagttgccctctggcggactcaatggaagacccgagaagttaccagatgtgtgctattcctggtgggtgttggcctccttaaagataatcgggaggcttcattggattgacagagaaaagcttcgaagcttcatcttggcatgtcaagatgaagagacaggagggtttgcagacaggccaggagacatggtggatccctttcacaccttgtttggcattgctggattgtcacttctgggggaagagcagatcaagcctgtcagccctgtcttttgcatgcctgaagaagtgctacagagggtgaatgtccagcctgaactagtgagctag

SEQ ID NO: 4239 - DNA, 389 bp, Rattus norvegicus
  Genbank Accession No. NM_138826
tcccgacttcagcagcccgactgccttcttgtcgcttacaccgttgctccagattcaccagatctcggaatggaccccaactgctcctgctccaccggcggctcctgcacctgctccagctcctgcggctgcaagaactgcaaatgcacctcctgcaagaagagctgctgctcctgctgccccgtgggctgctccaaatgtgcccagggctgtgtctgcaaaggtgcctcggacaagtgcacgtgctgtgcctgaagtgacgaacagtgctgctgccctcaggtgtaaataatttccggaccaactcagagtcttgccgtacacctccacccagtttactaaaccccgttttctaccgagcatgtgaataataaaagcctgtttattct

SEQ ID NO: 4240 - DNA, 2571 bp, Rattus norvegicus
  Genbank Accession No. NM_138827
ggggcgggccaatggcggcggtcctataaaaaggcagctccgcgcgctctcttcctaagaacacaagaatcccttgtggagtgtcggtttaggttgcagggtcttaagtgagtcagggcgcggaggtccggcgggagacgcatagtcacagaacgtccattctccgtttcacagcccgcacagcttgagcctcgagcgcagcgcggccatggagcccagcagcaagaaggtgacgggccgccttatgttggccgtgggaggggcagtgctcggatccctgcagttcggctataacaccggtgtcatcaacgccccccagaaggtaattgaggagttctacaatcaaacatggaaccaccgctatggagagtccatcccatccaccacactcaccacactctggtctctctccgtggccatcttctctgtcgggggcatgattggttccttctctgtgggcctctttgttaatcgctttggcaggcggaactccatgctgatgatgaacctgttggcctttgtgtctgccgtgcttatgggtttctccaaactgggcaagtcctttgagatgctgatcctgggccgcttcatcattggagtgtactgtggcctgaccaccggctttgtgcccatgtatgtgggggaggtgtcacccacagctcttcgtggagccctgggcaccctgcaccagctgggcatcgtcgttgggatccttattgcccaggtgttcggcttagactccatcatgggcaatgcagacttgtggcctctactgctcagtgtcatcttcatcccagccctgctacagtgtatcctgttgcccttctgccctgagagcccccgcttcctgctcatcaatcgtaacgaggagaaccgggccaagagtgtgctgaaaaagcttcgagggacagccgatgtgacccgagacctgcaggagatgaaagaagagggtcggcagatgatgcgggagaagaaggtcaccatcttggagctgttccgctcacccgcctaccgccagcccatcctcatcgccgtggtgctgcagctgtcccagcagctgtcgggcatcaatgctgtgttctactactcaacgagcatcttcgagaaggcaggtgtgcagcagcctgtgtatgccaccatcggctcgggtatcgtcaacacggccttcactgtggtgtcgctgttcgtcgtggagcgagctggccgtcggaccctgcatctcattggtctggctggcatggcgggctgtgctgtgctcatgaccatcgccctggccctgctggagcagctgccctggatgtcctatctgagtatcgtggccatctttggctttgtggccttctttgaagtaggccctggtcctattccatggttcattgtggccgagctgttcagccaggggccccgacctgctgctgttgctgtggctggcttctctaactggacctcaaacttcatcgtgggcatgtgcttccaatatgtggagcaactgtgtggcccctacgtcttcatcatcttcacggtgctgctggtactcttcttcatcttcacctacttcaaagttcctgagaccaaaggccggaccttcgatgagatcgcttccggcttccggcaggggggtgccagccagagcgacaagacacctgaggagctcttccaccctctgggggctgactcccaagtgtgaggagcccacagccagtcccgcctgctcccagcagccccgaggatctctctggagcacaggcagctagatgagacctcttccaaactgacagatctcgggcgagccgggcctgggcacctttcttcagtcagcaatgaagtccagaagaatattcaggactttgatggctccagaatttttaatgaaagcaagactgttgctcagatctattcagataagcagcagattttataatttttttattactgattttgttattatttttttttttatcagccactctcctatctccacactgtagtcttcaccttgattggcctagtgcctgagggtggagaccacgccctgtccagacacatgccttctttgccaagctaatctgtagggctggacctttggccaaggacacacgaatactgaacaatggctaggaggctttaccgcaggaggcggtagctgccacccacttctgcaggcctggatctcgacaccataggggtccaggctccatttaggattcgcccattcctgtctcttccaactcaaccaaccactcgattaatctttccttgcctgagaccagttgaaagcactggagtgcagggaggagagggaagggccaggctgggctgccaggttcaggtctcctgtgcactgagggccagacaaacaccatgagaaggacctcggaggctgagaacttactgctgaagacacggacactcctgccctgctgtgtatagatggaagatatttatatattttttggttgtctattaaatacagacactaagttatagtatatatctggacaaacccacttgtaaatacaccaacaaactcctgtaactttacctaagcagatataaatggctggtttttag

SEQ ID NO: 4241 - DNA, 936 bp, Rattus norvegicus
  Genbank Accession No. NM_138828
atgaaggctctgtgggccctgctgttggtcccattgctgacaggatgcctggccgagggagagctggaggtgacagatcagctcccagggcaaagcgaccaaccctgggagcaggccctgaaccgcttctgggattacctgcgctgggtgcagacgctttctgaccaggtccaggaagagctgcagagctcccaagtcacacaggaactgacggtactgatggaggacactatgactgaagtaaaggcatacaaaaaggagctggaggaacagctgggcccagtggcggaggagacacgggccaggctgactaaagaggtgcaggcggcacaggcccgtctgggagctgacatggaggatctacgcaaccgactcgggcagtaccgcaacgaggtaaacaccatgctgggccagagcacagaggagctgcggtcgcgcctctccacacacctgcgcaagatgcgcaagcgcctgatgcgggatgcggatgatctgcagaagcgcctagcggtgtacaaggccggggcacaggagggcgccgagcgcggtgtgagtgctatccgtgagcgcctggggccactggtggagcagggtcgtcagcgcacagccaacctgcgctggcgccgcccagccccgcgcgatcgcgcccaggctttgagtgaccgcatccgagggcggctggaggaagtgggcaaccaggcccgagaccgcctagaggaggtgcgtgagcagatggaggaggtgcgctccaagatggaggagcagacccagcagatacgcctgcaggccgagatcttccaggcccgcatcaagggctggttcgagccgctagtggaagacatgcagcgccagtgggcaaacctaatggagaagatacaggcctctgtggctaccaactccattgcctccaccacagtgcccctggagaatcaatga

SEQ ID NO: 4242 - DNA, 1870 bp, Rattus norvegicus
  Genbank Accession No. NM_138829
gcccttccggctgggtcgtacggatcgcccgccgccatgggctcctcgcagagcgtcgagatcccgggcggcggcacagagggctaccacgtcctgcgggtacaggaaaattccccaggacacagagctggactggagcctttctttgactttattgtttctattagtggttcgagattaaataaggacaacgacactctgaaggacttgctgaaagccaacgtggagaagcctgtgaagatgctcatctacagcagcaaaaccctggagctgcgggaggcctcggtcacacccagcaacctgtggggcggccagggcttgttgggggttagcatccggttctgcagtttcgatggggccaacgaaaatgtttggcacgtgctggaagtggaatcgaattcccccgcagcactggcggggctgagacctcacagcgattacatcattggagctgataccgtcatgaatgagtctgaagacctgttcagccttattgagacccatgaagcaaagcctcttaagctctacgtgtacaacacagacactgacaactgccgagaagtgatcattacaccaaattctgcatggggtggggaaggcagcctcggctgtggcattggctatggttatttgcaccgaatacctacgcgtccctttgaagaaggaaagaagatttcccttccaggacaaatgactggcacccccattactcctcttaaggatgggtttacgcaggtccagctgtcatcagtcagccccccatctttgtcaccaccaggaactgcaggagttgagcagagtctgtctggactgtccattagctcagctccaccggctgtcagcaatgttctcagtacaggtgttccgactgtaccattgttgccgccacaagtaaaccagtcccttgcttctgtgccaccaatgaacccagctgccacattaccaagtctgatgcctttgtcagcagggctgcctaacctccccaacctccccagcctctccaacttcaacctccctgctccgcacatcatgccaggggtcggcttgccagagctcgggaagccgggtttgccacctcttccgtccttgcctccccgaaacgtacctggcattgcacctctccccatgccgtccgacttcctcccgtcattccctttggttccagaaggctcttctgcagccagcgcaggggaaccactgtcttcccttcctgccatgggcccaccttctgaccctgtcatgactactgcaaaggcagacacctcctccctcactgtggatgtgatgtctcctgcttccaaggtccccaccactgttgaagacagagtgagcgactgcaccccagccatggagaagcctgtgtctgcagttacggatgcaaatgcttctggggcttcttaacttggaatcaaccttcagaactgatgtggtctgtctatttaaccatgggatcatatctggaatcgcaaactaccattgatttcatctagtttgtacgtatctgtaggggtcctgtacataattctaaggggaaactgcacaagagtctgaaggcttgtctcccaccaagttgggggaattacagccaaggaagggaatctgacaatgtgcctgtatcttaaacaaccaaaaaaagttgttatgggtggcttgctgccaagcatctgctgccattctgggatgttcgtctttggaagaaacgcggggggcctgctaaaatccctgtaccactggctacgccttgtgtaaggaaataaaatattttatgcctagtgcccacacccaacatttcttgttctttgtaagttctttgcaaaaacacaacacctcctcctaaactgttaaaaggaaaaaaaaaaaaaaaaaaaaa

SEQ ID NO: 4243 - DNA, 1830 bp, Rattus norvegicus
  Genbank Accession No. NM_138839
tgcgatccggagaagccggggtctgagcggctcctccagagttactgatctatgaaatggcagagaatggaacaaattgtgaccagagacgtggagcaatgagtaaggaacagcataatgggagtttcacagacccctcttcagtaaatgagaagaagagaagggatcgggaagaaagacagaatatcgtcctgtggagacagccactcattaccttgcagtatttctctctggaaactcttgtagttttgaaggaatggacctcaaaattgtggcatcgtcaaagcatggtggtgtcctttttcctgctgcttgctgcgcttgtagctacgtattatgtggaaggagcgcaccagcagtatgtgcagcggatagagaagcagtttcttttatatgcctactggataggcctggggattctgtcctctgttggtcttggaacaggattgcacacctttctgctttatctgggcccacatatagcttcagttacattagctgcttatgaatgcaattcggttaatttccctgagccaccctatcctgaccagattatctgcccagacgaagaaggcactgaaggagccatatctttgtggagtatcatctcaaaagttagaattgaagcctgcatgtggggcattgggacagcaattggggagctgcctccatatttcatggccagggcagctcgcctctcaggtgctgaaccagatgatgaagagtatcaggaatttgaagaaatgctggaacacgcagagactgcacaagactttgcatcacgagctaaactggcagttcaaaaactagtacagaaagttggattttttggaattttggcctgtgcttctattccaaatcccctgttcgacctggctggaataacatgtggacacttccttgtacctttttggaccttctttggtgcaaccctgattggaaaagcaatcattaaaatgcatatccagaaaatctttgttatagtaactttcagcaaacacatcgtggagcagatggtggctttcattggggctgtacccggcataggtccgtctctgcagaagccttttcaggaatacctggaggcccagcggcagaagctccaccatagaagcgaagcaggcacagcgcagggagaaaactggttatcctggacgtttgagaagctggtcgttgccatggtgtgttactttatcctgtctatcattaactccatggcacaaagctatgccaaacgaatccagcagcgcttgaactcagaggagaagactaaataagcagagagtttttatctgcagaagttagcgtggtggagcctgccttacatcgggagggctctcaccaggaaggaagatccccatttccaacctgtactgatttttaaaacatttctccctgaaagcagtttagtccacattttacactgacatacttttgctttctttgttaaggtaaggtctccaccctcgattcaatccacattgtattccttagggtggatatgatgttctgctgcaaacttaacaaaactggccttctgacactttcacagggccacatggtccaactggagaacctcggccacacagaaccttctgacgtatgttaaatatgccaggcttttcaggcttgtcacaaatgattggtttttctaagtcaccaaatgtatataagttatatatgttggatagcagtcttgcatgcctatcatggaacaatgtaatatgccttcctttcccaccctcaaaaaggccattttatgatgcattgcacaccctctggggaaattgatctttaaattttgagacagtataaggaaaacctggcccg

SEQ ID NO: 4244 - DNA, 2750 bp, Rattus norvegicus
  Genbank Accession No. NM_138840
cagactacaggatgcagttcctggttgcgttgctcctgctgagtgtcgcggtggcgagagctctgccatccgcttctaagccaaacaacacatcaagtgaaaataatcctccgattcaaccttccacgcccctgcctcctggggttgatatttctcaacaggtaaagactaacagaccgactgatcagaggctggagtcggataaagaaggccaggacaagacggtggctaggacttcggcatcagtttccagtggggtggaatctgcgaccaatctcaatttggatgattccaaaaagcaccccgaaacagcagatgccaaattgaaggaaactttgcagcagcttttgcctgtggaccccaaacaggaaaagtcaggtcagaagtttacaaaagattcaggcagccccacaggaggtgattccgacaataccacaggaggtgattctaacaagaccacaggagttgattctgacaagacatcaggaggtgattctaacaagcccacaggaagtgataatgacaagcccacaggaggtgattctaacaagcccacctccaaagtcccctccaatacagagactccaaaaattgacaaagtccagctaactgaaaaaggacagaaaccaacacttatttccaaaactgaatctggggaaaaactggcaggggactctgacttctctttaaagccagagaaaggagataagtcttcagagcctactgaagatgtggaaaccaaggagattgaagagggtgatacagagcccgaagaaggttcgccacttgaagaagagaatgaaaaggtgttgggcccttcctccagtgagaaccaagaggggacacttacagattctatgaaggatgagaaggatgaccattataaggacaattctggaaacaccagtgcagaaagcagccacttctttgcttatctggtgaccgctgctgttcttgttgctgtcctctatattgcttaccacaacaaacgaaagattattgcttttgccctggaaggaaaaagatccaaagtcactcggaggccaaaggccagtgactaccaacgtttgaacctaaagctttgattttgattttgtctgcaagaaccttgtcctccctgctgatttgtttccgaatcaagagaaatgaaaagactgacctgtggggtttggtggcaagtctgggctggcagagatgggattgcttcaggttttgcacctgcactttgatgacagtcctctggtggtgttttatttacttttgtgttccctttatgtgatgtgtccatcttccttccattcttggagtacaagcagagggagtgtgtggaaacatggctgtgaccaaaggaagaccccaccttccttaggcaggccacactatggaccaccctcccataacccctttatctttgcaactctaggagcaaactacagaggtgctttctagacaagatgtagaagatgattctgtgggatgctgatgggcagagacagggttgaaatcttctccacagaggcctcagctgcagaccagactagcaagttaaagagtgtcaaggtccagtccgtctgacagtctgtatatctctctgaaatttgcactcgagttgtgctagcacaaaagggactcactgcttctgaaagtaaaatcactgtgccatgggatttttttttttttaaatatggtgatgattattgaactgaaccagtgtgttcttgcatacagtcaccccaataggaacttcctggaaagaagcaaggtttatgccttgtggaagaaaacacatagggctttggtatacaggaaagagtttctcacagtcagttttgctttcatggtctgcagtaggtaagatagacatttagaaactccgtgcgttctccacattcctccacactgtttaagatgccagggaatgagtaatatctttcctatcctgtcatagctactcatgaaattgtaagaaaccaagtaggttccctgagataaccaaagatgtcttggattatgctgtgtctaaagttttattccagtctatatggttacacctaaagagagaaaactcttaactaatctcagggatataaaaggaaccaaaaatctgagtcctgtgcagttggagaagttgaagaagacctggtcttggagctctttctccatgctgactgtagcatgtgcctgaagtttgtatgcttggcaggtggcattctagaaatgaggtcattgctactgtcttcccgactgtgcataagtctgctgttactttttcctagctgagaagccgttttcagtctccctcagctttccgtaactcttcttcagttccccacctcttccattctctcttcctctttagccctgtttgtacacctctgatgaaaacctttccttctagcctacgtgcatgccatccctaccccgttccagttggtgttgcttctattcccttccctctctccctgacatttgcaggtttgccttggtctgttttcctcctgtttctcaaggttactcagttaacagatcaccaaataaaacagcccattttcacagcttataacacttggtaatgatggatgctggggtctgtgcatgttgacattctaggtgtctcttgcaaactgtcctttgccttatcttatggcgttgggggagggtgcccaggtctctcttgctttgactgtcgcatccattatttatcctttctgtgacctcacatttctttggtctccttcccaagaacccag

SEQ ID NO: 4245 - DNA, 1304 bp, Rattus norvegicus
  Genbank Accession No. NM_138843
gaattccgtctggcctccttccctcccctgggtaccctcttactgtctgccacctctcggctacctccactgagtgcccaggagtcactgaaactcctggtctctgggatatcaccttaaacaccacctgagttgtctgaggaaggactcttggcaaagcagggtcagagtgactttgctggccctgcaatccgagcgtcccctaggccatggctgccccacagcttttccgagctctggtatctgctcagtgggtggcggaggctctgaaatcccctcgcgcctctcagccgctgaagttactggatgcgtcctggtacctacccaagctgggccgcgatgcgcgacgcgagtttgaggagcgccacatcccgggcgccgccttctttgacatcgatcgttgcagcgaccacacatcgccctacgaccacatgctgcctagtgccacgcatttcgccgactacgcgggcagcttgggcgtgagtgccgctacacacgtcgtgatctacgacggcagcgaccagggcctctattccgctccgagggtctggtggatgttccgcgccttcggccaccactctgtgtcgttgctggacggcggcttccgctattggctgagccagaacctgccaattagctctggcaaaagcccctcggaacctgcggagttctgcgcgcagctcgatccctccttcatcaagacccacgaggatatcctggagaacttggatgcccggcgcttccaggtagtggacgcccgcgcagctggccgtttccaaggcacacagccagaaccccgagatggcatcgaacctggacacatccctggctcagtaaacatcccattcactgaattcctgaccagtgaaggtctggagaagagcccagaggagatccaacgcctgttccaggagaagaaggtggacctgtccaagcccttggtagccacatgcggctccggtgtcacagcctgccacgtggtcctgggggccttcctctgtggcaaacccgatgtgcctgtctacgatggctcctgggtggagtggtacatgcgtgcccaaccggagcacgtcatctctcagggccgggggaagaccctgtgaaggacacagtgcagcttgggtgacaccgaaccatcctagtgccagcctggtcactctgaccctgctttgccaagagtccttcctcagacaactcaggtggtgtttaaggtgatatcccagagaccaggagtttcagtgactcctgggcactcagtggaggtagccgagaggtggcagacagtaagagggctgccggaattc

SEQ ID NO: 4246 - DNA, 1175 bp, Rattus norvegicus
  Genbank Accession No. NM_138847
ctttggtgtacccaggaagtagagataaagtgacttccacttccggctctccagggacgaggatccggagagccaagctagtgggtaaaatgaggcctttgactgaagaagagacccgcgtaatgtttgagaagattgcgaaatacattggagagaatctacaactcctggtggacagaccggacggcacctactgtttccggctgcacaacgaccgagtgtactatgtgagtgagatgatcctgaagctggccgccaacatctccggagataagctagtgtccctgggtacgtgttttggaaagtttaccaagacccacaagttccggttgcacgttacagctctggatttccttgcaccctacgccaagtataaagtgtggataaagcctggagctgagcagtccttcttgtatggaaaccatgtgttgaaatccggtctgggtcggatcactgaaaacacgtctcagtaccagggagtagtggtttattccatggcagacgttcctttgggttttggggtggcagcaaagtctacccaagactgcaggaaagtggaccccatggcaattgtggtgttccatcaagcagacattggggagtacatacgccatgaagagacgttaacttaagatggccatcccaagaacattttgctgtgtgagaagacttagctttgtttcctgtgtgccggccatcatgtttaaatctggataacactgagatatgcagcttggattcttatcaacagaaatggctcaaaaataggtttctggcctctacaaccaaatgcaggtggatcacaaggataaggccactcaggctacttggcaattccaggctagcctgggctacctagtgaggcttgtctcacaaattaaaacagacaaatcagaacctatgagcatttgtgtgagcaaattgagtgtttctattttatgtctgcatcatcgttgattcagaagccttgttctgagtgacggtttctaagttacttcaccgaggacagggataatcttactgttatctgtgataactcttttccaggcttataacagcacagtggactttctaatgtttgttaatattaaagttagaaacagctatataaggacagtaggccatgcctatggttttatatatggagtttaataaattgtaatggttttattttc

SEQ ID NO: 4247 - DNA, 990 bp, Rattus norvegicus
  Genbank Accession No. NM_138863
atggtacaagctaagacctggaccctaaagaagcactttgaaggcttccctacggacagtaactttgagttgaggacgactgagctcccacccttaaataatggagaggtcctgctggaagccctgttcctctccgtggacccttacatgagagttgcagcaaaaaaactgaaggagggcgacagcatgatgggtgaacaagtggccagagttgtggaaagtaaaaactcagccttcccaacgggaacgattgttgtggctttattaggttggacatcacattccatttctgatgggaatggactgagaaagctacctgcagagtggcctgacaagctaccactgtctttggctttggggacagttggcatgccaggcctcactgcctactttggcctgcttgacatctgtggcttgaagggtggagaaacagtgctggtcaatgcggcagccggggctgtgggctctgttgtggggcagatagctaagctcaagggctgcaaagttgttggtacagccgggtctgatgaaaaggttgcctatcttaagaagcttggattcgatgtggcctttaactacaagacagtaaagtcattggaagaagctttgaggacagcctctccagatggttatgattgctactttgataatgtcggtggagagttttcaaacactgttatactgcagatgaagacgtttggaagaattgccatctgtggcgccatctctcaatacaaccgcactggcccatgtcccccaggcccatctccagaggtcattatctatcagcaactccgcatggaggggttcatcgttactcggtggcaaggagaagtccgccagaaggctctgacagacttgatgaattgggtttcagagggtaagatccggtatcatgaatacatcactgaaggatttgagaagatgcccgcagcgttcatgggaatgttgaaaggagacaatctggggaagactatagtgaaagcgtga

SEQ ID NO: 4248 - DNA, 1556 bp, Rattus norvegicus
  Genbank Accession No. NM_138865
accccatggttactcctgtaggctatggctgtcgccgcttcctgcagggtcaggctccacctcgcctcaaagtcgatctaagtgctcctctgtgcaaggcgataggatggaaaccatcccctcactgctgttcagattttcacgtcctacatgtactaagagcttaatgaaaatggacacacttcctgccttcctagagcaaatagaataacagggaggatacatggaaattgttgcacagctgtcctatccgtatgagatctccagtttaccctgagttacacgagacgatgaaatacattgccaagaagtgtggagttaggttccagcctccggccatgatcttgatttatgagaatgaagctgaaggaaagagccgccagcgcatcatgcctgtccgaaacttttcgaagttctcagattgcaccagagctgctgaacaattaaagaataacccacggcacaagagttacctggaacaggtgtccctgaagcagctggagaagctgtttgtttttttacgaggttccctacaggggcagagcctggcagaaacaatggaacagatccagcgggaaacaaccattgatcccgaggaagacctgaacaaactggacgacaaggagctcgccaaaaggaagagcatcatggatgagcttttcgagaaaaatcagaagagaaaggatgaccccagttttgtgtatgacgtggaggttgagttccctcaggatgagcagctgcagtcctgcagctgggacacagcatccgtcgatgagttctgagactacgccacgtttccacaaagaaggaagagcggttctagaaaacactgagacacgaatgatccgtaaaaccaagacacttaacatgtcctacacagccctatgagaaacacagaaacacaagataggaatctgcaatctaaagagaaagtaactcgagaacttgtaaaaaggtattttattatattactcaggaaaaagctaagagccaggtatttgatgaaggctgtagaaaggtcaatacctgcttgaccttgaaatgctacagatgtattttatagaaatcgagatgaagcaaagggggaagggggaagtaaagagacaagaaataggaaaatctgggaaagggtgagtaattatagtttgacaagactagaattaacctgtgctcattaggaccctgtgtgcattaactctggggtagacaggaatacctataaatgcaaaatgtctcacagctacaagtacatgtggcagaaggcaggcaagtctactccgcgatcaggaaatgtgttctaacgttactctgaaacccagagccacttcctgtgaaagactggtttgtacaatgggaagtctgcccacaatgagcgataggtgctgctgttcagacctgttcgtaagtttagttgtgcaaagatcgcagcctcacaaggcctctgtgtgcagatgtgtttgttcttactagaatgttatctgattgatagaaatcatatgttttctacaaggaaaccattacgcatcgaataaagccgtgaatgcaaaaaaaaaaaa

SEQ ID NO: 4249 - DNA, 1893 bp, Rattus norvegicus
  Genbank Accession No. NM_138877
gggtgtagaacggtgccaccactgtcttcttcgccaccatgggggcccagctgagcacgttgagccgagtggtactctccccggtctggttcgtctacagcctcttcatgaagctgtttcagcgctcctcaccggccatcaccctcgagaaccccgacatcaagtaccctctgcggctcatcgacaaggagattatcagccacgacactcggcgcttccgatttgcactcccttcgccccagcacatcctgggccttcctatcggccagcacatctacctctccaccaggatcgatggcaacttggtcattcgtccctacacccctgtgtctagtgatgatgacaagggctttgtggacttggtggtcaaggtttacttcaaggacacgcatcccaagtttccagctggagggaaaatgtctcagtacctggaaaacatgaatattggagacaccattgaattccggggccccaatgggctactggtctaccagggcaaagggaagttcgccatccgtgcagacaagaagtccaaccctgttgtcaggacggtgaagtctgtaggcatgattgcaggagggacaggcatcaccccaatgctgcaggtgatccgagccgtcttgaaggacccgaacgaccacactgtgtgctatctgctcttcgccaaccagtccgagaaagacatcctgctgcggcctgagctggaggaactgaggaacgaacattcttctcgcttcaagctctggtacacagtggacaaagcccccgatgcctgggactatagccaaggcttcgtgaatgaggagatgatcagggaccatcttccacctcctggggaggagacactgatactgatgtgtggacccccaccgatgatccagtttgcctgtttgccaaacctggagcgtgtgggccatcccaaggagcgatgcttcaccttctgatggctggatgctggccactcccatgcctgctgctcacgcactcaccacaaccaccttccaccccttccttccccactactgtcctttaccctgacatatgcccacatccatgctggggcctgggttcagcctggcctgcccagccctggtcatccagctgtactggcccctgaggggcccctttgggagcaggcctgtgtatcaggtggcttctgttgaccactttctgaataggcttctgtctggtactaactggccattaccagagatggtccatgaccacccctttatacacacacacatacacatacagagacagagagacagagagacagagatagacagagatagacagagagacagatacagacatagagacagacagagacagagagagaggagtcagagagctgttagtaccatgtctacccgttaccatggaccgcaatgtgtagtaaggaaatgaaaggtaaacagttatctacagtcctaggaaccatgcctgtcacctaaccacctactgccttaggctatggcctggtctgtgcccctaaacactacattagacagtgacacccagaggttctcttaggagggtgtctggcagtgacaggccagcccccacttgctggccaggagttccttgggtcagcacgtggacccttccaaaaccccacacactgcccctcccctccatgatgccttgagcaccctaagttgtcagcccaacagagtttggtagaccttggggtacctggcttgtttctccatcccatacctccctcccatctggttcccagcctggggggttctgagcagagcctcttttctcggagacagacccggtgcctggcgctgccttcagcagacagcagacagcctcctgcacactggctttttttagtcatttatgggcaaaatgagttaaaataaaactttgcaaatcctg

SEQ ID NO: 4250 - DNA, 588 bp, Rattus norvegicus
  Genbank Accession No. NM_138878
gcgaccacagcgggagaagcagcactctagccgcctgtaaccccaacctgggaggaagatgctaattaaagtgaagacgctgactggaaaggagattgagattgacatcgaacccacagacaaggtggaacgaatcaaggagcgtgtggaagaaaaagaaggaattcccccacaacagcagcggctcatctacagtggcaaacaaatgaatgatgagaagacagcagctgattacaagattctaggtggttccgtcctccacctggtgttggctcttagaggaggtggtggtcttgggcaatgaagaaacttgattctgttttacctccttgtcctgccgctcataatgtggcatcacatatcctctcactctctgggacaccagagctactgcccccttccttggatgcccaatcttgtgtgtctactggtgggagaatgtgaggaccccaggatgcagtgttcctggcccaaatggcccttgctggccattgggttttaatttgcagtcctgtgtgcttccctctcttatggctatatccttggttgtcaataaaatatttcctggcaaaaaaaaaaaaaaaaaaa

SEQ ID NO: 4251 - DNA, 3628 bp, Rattus norvegicus
  Genbank Accession No. NM_138881
tggggatgctagtgcctactgcgctggctgctcggctgctgagcctgttccagcaacagctgggttccctctggagtggcctggccatgctgttctgctggctgagaatagcattggggtggccagatcctggaaagggacagccacgggtccggggtgagcccaaggagactcaggagacccacgaagatccaggcagtgctcagcccacaacccccgttagtgtcaactaccacttcacgcgtcagtgcaactacaaatgtggcttctgcttccacacggccaagacatccttcgtgctgcccctggaggaggccaagcgaggactgcttctgctcaaacaggctggtatggagaagatcaacttttcaggaggagaacccttcctacaggacaggggtgaatacttgggcaagctcgtgagattctgcaaggaggagctagccctgccctctgtgagcatagtgagcaatggcagccttatccgagagagatggttcaaggactatggagactatttggacattcttgctatctcctgtgacagctttgatgagcaggttaatgttctcattggtcgtggccaagggaaaaagaaccatgtggaaaaccttcaaaagctgcggaagtggtgcagggattacaaggtggctttcaagatcaattccgtcattaatcgcttcaacgtggacgaagatatgaatgagcacatcaaggcgctgagccctgtccgctggaaggttttccaatgcctcctgattgagggtgagaactcaggagaagatgccctgagggaagcagaaagatttcttataagcaatgaagaatttgaagcattcttacagcgtcacaaagatgtgtcctgcttggtgcctgaatctaaccagaagatgaaagactcctaccttatcctggatgaatatatgcgctttttgaactgtaccggtggccggaaggacccttccaggtccatcctggatgttggcgtggaggaagcgatcaaattcagtgggtttgatgagaagatgtttctgaagcgcggggggaagtatgtatggagtaaggctgacctgaagctagactggtgaggtgagattggacggagactctaaccagctacgaggagtccacgagcagccgctcgccaccacgcacatctggctgtctacggactgttgctactgagaatgcactctatgttctttctttcagtttgactgaactaagaaaggagtaaaaccattctgtgaacccttatacagccgataagggtcctccacaggggaaggagttcagttcacagaggaacaaggtccagcgatctcaaagaactcacattttatttgtattcgaatttttgtatggatcgttactgtgaatcccatgtttccttttccctttctgttcccccatgagaaactgggttattttctgctaactatgccagttttgtcaacaggaaggatcacaaaacacaccctgcgattactgctgactgttctaatgcttttctgctttggaatctcggactttttgctcagaaatatagaatcaagaagtgtgttatagagccgtacgtgagaaccttactcttttgcaaggagcatatggaaggaggtacttctgaggacggtgtgttcatggcctcagcctctgctgctgctgctgcttcaaggatggctgttctatatcgtaccaattccttcaaggttctggacaaagccaaggtacactttacctttcatggcatggccgtgaagatggcactgacagccgcaaccaccccagcactgaggctgcctgagtctgtcaggctaaaaggttgtcccacttttctgaaaagctacaagggctcttctgcacatccagcagaatcatgacaggatgggcatggaggactcttcaggagtatgaaatgtggctgctgctccttaccatatttctcatgaaactctgaaataagacctagtagtctaggtcaccatgagaaaataatttcttctctacatcaaataagcaaaagagagaacatgaactagcccaaatcttcttcctgtggaagcattgcatgagtttattcaacctagacagcctcactgcttggaaaataattccctggaaattaaataaataccatggaaaagaaattaaactcctctgcaatcccactgtggccactagagggcaccaggaagtcagacttcattgtctcagagacttttcttcagtctttttttagaatttggtgaattttaattctgttccttatctgttttgtctttgttttttgttttggtgcctattactaaaattaatactaaacattttccaaggaactggaattttggccatttacaaaaggtcttcattctttagtgaggtcactataattcaactaagacatactctgtctcattaaaaataggtcaggttttcctgtgttttctgtcttgtttggttgtgtgtgtgtgtttacctatttttgcttgaatatagatataactatgtatcccaggctagcctggaactcatgatacctctgccttaacctccccctcttaagtgcccaggaattacccaactcctgtacagagatttttaagagaagtttgagtcacattcccccctgcagattgtgatttttttttttaagttaagtcctgtgtacatagttcacatgggaaaccatgacatcccagaggacatgggcagacacccacttggtcacacgacagagggaagctgcatgtttctttccctaattaaagtagagcatgaagaaagtatgattggaaagtgagccatcatttacatgtacccccaaccccttgtgcatgcactggcggtgggagatctctgtgcttaaaatattgaaaagtcccctttccttaaagggaaaaattacgatattttactatcgtagtacaaatcaaacttggattagatcatacattggtttgctttttcagtgttaaatktgggtgttcattttgtaaagcatacgctccctgctggggaaacaaggagtgatctagttgacatttgttaagtgtgaccagcagataccttgtgtcccatgattgatttatgcagagcagtaatactgggaagggggatttacttaagaacatcgacgggtaggacatccaacactgatttcaaagttttggcttctttattataatgtgttcggcggtaaaaaaaagtcatgggttgttttctttgaagctgaaagtctcatggtgttatttacctaaattatctgaaaaatttaaaaggggcccaggtttcattctgcgttggagtttgggggtctaattgttgcataaataaacaggcaaccaatcatcagaggttgactcctcccatcaataattcagctcgtgttttacccttttgatggactgatgttgtttcataagctattagtagtccaagaacaatcatgcaggcctcatgtgaatgtgttcagatgaggtttgatgttcgggatacatgtgcatgtatctccctgtagaatgacactgtattttgaggcattgctctagtgtatggaaacgtgatctgtgtattaaaatgttttatgcatgacctcaaaaaaaaaaaaaaaaaaaaaaaaaaaaaaaga

SEQ ID NO: 4252 - DNA, 707 bp, Rattus norvegicus
  Genbank Accession No. NM_138883
aaagatggccgcaccagcaacatccgtgctgtcccgacaggtgcggagtttcagcacatctgtggtcaggcccttttcgaagcttgtaaggccccctgtccaggtctacggcatcgaaggccgctatgcaaccgccctgtactctgctgcgtctaagcagaaaaggctggaccaggtggaaaaggagttgctgcgagtggggcaactcttgaaggaccccaaggtgtcccttgctgttctgaacccctacattaagcgctccatcaaagtgaaaagcctgaaggacatcactacaaaggaaaaattctctccgctgacggccaacctcatgaatttacttgctgaaaatggtcgcctaggcaacacccagggcgtcatctctgccttctccaccatcatgagtgtccaccgtggagaagtgccgtgcacagtgaccacagcgtttcctttagatgaagctgttctctctgagttaaagacagtgctgaatagcttcctgagtaaaggccagatactgaacctggaggtcaagactgacccatcaatcatgggtgggatgattgtccgaattggagagaaatacgttgatatgtctgcaaagagcaagattcagaagctcagcaaggccatgcgggatctgctctgagagactgtcacctgtgtgagcgcttgtctttggagcacaataaaatgcttcctgaacagag

SEQ ID NO: 4253 - DNA, 3189 bp, Rattus norvegicus
  Genbank Accession No. NM_138884
ttcagaatcactacttgaagcttcagatcccttctctacaatgaacctcagcactgcaaaccaccacatacccctaaatgatggtaacagcattccgatcatcgggcttggaacctactcagaccctagaccggtacctggcaagacctttatagcagtgaagacagctattgacgaggggtaccggcatattgatggggcctacgtctaccgaaatgaacatgaagtcggtgaggccatcagagaaaaggtggcagaagggaaggtaaagagggaagagattttctactgtggaaagttatggagtacagaccatgatccagagatggtccgcccagccctggaaaggaccctgcagaccctcaagctagattacatagacctttatatcattgagatgcccatggcctttaagcctggagaggaattttatcctaaagatgagaatggccgagtgatataccacaaatcaaatctgtgtgccacgtgggaggcactggaagcttgcaaagacgctggcttggtgaaatcccttggggtgtctaattttaaccgcaggcagctggaggtcatcttgaacaagccaggactcaagtacaagcctgtcaccaaccaggtggagtgccacccgtatttcacccagacaaaactccttgaagtttctgccagcagcatgacatcgttcattgtcgcatacagccccttagggacctgtcgcaacccgttatgggtgaatgtatcttctccacccttgttaaaggatgaactcctaacctcgctggggaaaaagtacaataagacacaagctcaaattgtgttgcgtttcgacatccagcgagggttggttgtcatccctaaaagtactacccctgaaaggatcaaagaaaactttcagatctttgacttctctctcaccaaagaagaaatgaaggacattgaagccttgaataaaaacgtgcgctttgtggagatgctcatgtggagtgatcatcctgaatacccatttcatgacgaatactgaacatggaaatttcttcagtggagttttttttttgtctttcattcgggatcttgagctgattaatcccctccagtcgtagaaataaatggggtcttgctatcttcagattaagttgagcagaatacaccatgcttaacttgtgtatagtattaattcaacttagctctgatgaagagaagatttaaatatatctaaatagtttgttggaaaatgctttactagtatctttagctcaatgtgttctagattgttgatggaaattaccgaactttaattcaaaaataacaaaatatataaaatacaagatacaatataaaatataaaatacaaaaatataaaaacaggttctaacccaggagtctgagactaccatagggagtttgatttgtttagcatttagcaggacaacaaaagaggttggcatgcttccaggtgctgaccataaccatgacccaaacaaggtcatggacacaagatggacacagccaagacacaaatccacataccaatattaatgcaccttgagtatagacagaactgaaagtctagaaagtctaaagaagaacataaagcaggatgtcccggggctagaggttctcactggaggacttgcctggcagactggagacccagggtgagggtgtgggtgaggactatcagcaaagccataacgattctgtttttaccctttgtttccatccagtgtgcccattcagcttttaatgtgcttgaaggacagacagttaccgattccttcttaaattgtttttgttcagggcagtggggaattgagacagggtctcaggtagtctgctcatgtagctgcttacaaacttgctgtgcagctgagaccagttttgaattctgaacccctggtctctcttccatttttcatggcctgagcttccacctgactggtaagtccccacttgtactgtgctgtaatcattcttgcccacttcatcaaggaaaccaccatgtaaagtggcaagaaacaatcaatatatacaaccaagatttgtatacaatatggtctgaagatggtgatttttaaaagaatgatatttaaatagccatttctttctttctttctgaatctttaaaaattattttatttatgtgcattggtgttagctgcatgtgtatctatgaggaattgtttgaactcatggaactggagttacagacagtggtgagctgtaggtaggtgctgggaattgaacccaagtcattgggaagagctgcaagtgctcttaactgctgagccatctccccagcccccaaatgaatttgggaaatactagaagataaagctttgtaaagtagtttttaagatcttaagaatatttgaggtacgtatctgaattttgacaaagctgcaagttcttttttttaaattggatttttaaaaatttatttacatttcaaatgttatcccctctcctgggttcccatccacagacctccctatctcatcccccctctcccttcttctatgagagtgttcacccacctacccactccttccctcctccctgccctgacattcccctacactagggggtcgagtcttggcaggaccaagggcctctcctcccattggtgcccaacaaggccatcctctgctacataggcagctggagccatgggtctgtccatgtgtctctctggatggtggtttagtccctgggagctctggttggttggttctgttgttatggggttgcaaacccttcagctcctttaatcctttctctaattcctccattggggaccctgttctcagttctatggttggctgtgagcatccacctgtgtatttgtcatgctctggcagagcctctcaggagaatcaggctcctgtcagcagagcacaagtaattttagcgtatataaatttttaaaaagtgataaatgattacaactgtatctatttttaattcatctgaaatacagtacatttgtttatattagatcacttccaaagggtgagagatctctaatatatttaattcatagagaatcaatggccgaagagaataagttttgagaattatcacttaaaaatgtgatcaacatgaaccatttttgttcaatactgttcaatattgttaacaatgctgttctctggaaaatattttattcacatgaattaataaaatataatg

SEQ ID NO: 4254 - DNA, 10170 bp, Rattus norvegicus
  Genbank Accession No. NM_138885
ggcgcgtcggtggtggcgctgcgcttgggttacccgagctgacgtggcttagattgggcggggggcgtccggagttgtctgggacggccacctacagtgcttgaagaggtcagaaaaggacatcagatcctctaggactagagttacggacagttgtgagcagccacgtggatactgagaggcgaaccctaggccctctggaagagcagctggtgctcttaacctctgaccaactctgcagaccccactgtgagtcatttttctccgtgcccatggagcgctccttcagagatgctgagccgattatcgggattagcaaataatgttttgcatgaattatcaggagattacactggctggactacaatgacttcctcggaagctgaattaccccagggttctgccatggaattgaataatagtacccaaaaggacgttctggatcgcctggctgatgcagagaagttagtgctggagctaaaggatatcatcagtaagcaggatgctcagctccagcaaaaggacgaagctctgcaggaagaaaaaaaaggagctgaaagcaaaattaaaaaaataaaacttcatgcaaaggccaagatcacgtccttgaacaaacaaatagaagaattgaagacacaaggaggagctgcctcgcctccagaagtgcaggcagaggagctctccaagcatgataagagttcaacagaagaggagatggaggtagaaaaaataaaacatgaactccaggagaaggagaaattaattagcaatttgcaagcccagctggaccaggcgcagtcagaacaagcctcccagttggataagagttctgcggagatggaggacttcatcctgatgaggcagaagctccaagagaaggaggaactcatcggcgctttgcaaacgcagctcagccagacacaggcagagcaagctgcccagaaattgagggtgatgcagaggaagcttgaggaacacgaagaagccttgctgggccgagctcaggttgtggacctgctacagaaggagctgacttctgcagaacagaggaaccaggatctttcacagcagttgcagctgttggaggctgaacacagtactttaaggaataccatggaagcagaaagacaggagtccaagatcctgatggaaaaggtagaactcgaaatggcagagaggaaggaagagctgtatcagcttcagggacagttggagcgagcaggccaagcccaggctgagctggagatgcagtacggtactctccagcaaagacatgagacagaaatggaggagaagacagcttgcatttcgcttcttcagaagaacgagcaggagctgcagtctgcctgtgacgctctgaaggaggaaaactccaagctgcttcaggagcagcaggaacaggctgccaagtcagcccaggccctgcagcagctggaagatgaactccagcaaaaatctaaagaaattagccaatttgtaaacaaaccaaacttggaaaaacatgagacatcatctcagacgtctttaccagatgtttataatgagggcgtacaggcagtcatggaggagagtgtcgcctctttacagaagagagtactagagctagagaatgagaagggagccttgctccttagttctctagagctggaggagctgagagctgagaacgaaaaactctgttctcggattactcttctggaggctcagaatagagcaggagaggctgatggtatggtctgtgaggtcagcacagctggtattgctttgctcaacaggagcgactcttctactgaagaaagtggacaggatgtcctagagaacacattttctcagaaacataaagagctgtcggttttattagtggaaatgaaggaagcccaggaggaaattgcatttcttaagtcgcagctgcagggcaaaaggcctgaaggggactatgaggtccttgatcggaaagaagtacagatgatggagagtgaaggactgccctcagttacagcacgagatgtcctctgtgcgccccgtgacaagaacagtgtcccagcagtggaaggggaacaggcaggcatgagagatcagcacggaacattggaggcgggacctctaaatgacaccggaatggaactgaactccccacagccggacggtgtggacaaatccctctctgcaccacatgtctgtctgtgtcaccagggtgaactggaaaggctgaaaactcaagttttggagcttgagacaagccttcatacagccaaggaaactcatgagaagaatttaagtgagaaagcgaaggaaattagcagcctaacccagcttaccaaggagttcaaagagagtgcggaggaagcccgcagcacgctcactgctgtgtgtgaagaaagagaccagctgctttaccgggtgaaggagcttgatgtccttggagaactccgggctcaggtccgagaactggaaaccagccttgcagaagcagagaagcaaagaggtctggactatgaaagtcagagggctcagcacaacctgctcaccgagcagatccacagcctaagcatagaagccaaatctaaagatgtgaaaatcgagactttacaaagagagctggatggtgtgcaactacaattttctgaacagggaacacagataaaaagcctacagagccaactgcagacgaaggaaagtgaagtgctagagggggcagagcgtatgaaggacatctcaaaagaaatggaagaactgtcgcaggcgctttcacagaaggagctggaaatagcccaaatggaccaactcttgttagagaaaaagaaagatgtggagacactccagcaaaccatccaggagaaggatcagcaagtgactgaactcagcttcagtatgacagagaaaatggttcagcttaatgaagagaagttttctcttggggtagaaattaagactctgaaggagcagctcagtttattgtccagagctgaaggagcaaagagagagcaggtagaagacagtggagctgagtccagccctaaacatggtccacatgagtcgagcgcagaggagccagtgtgtaaagaggcactacagcaagaacttgagtggctgaggaaagagagtgagcagaggaagcggaaactgcaggcagcgctgatcagcagaaaggagctactgcagaaagtcagcaagctggaggaggagttagccaaggtgagagaggagtccacaaaagactccctcagggagagtgagaagagagagctggaggaagacagcaagaacaaagatgacccagaaaagtatgggacttctgagtggagagaactagaggtttctttaagactgacaatatctgaaaaggaagtggaactggagggcataaggagggacttaaaagaaaaggcagcagcagaagaagagttacaggccttggtccaacggatgactcaggacctgcagaataagacaaagcagatagacttgcttcaagaagagatcactgaaaaccaagcaactattcagaaattcatcacaggcaccatggatgctggggatggagactcagcagtaaaggaaacctcggtgagcagcccaccccgtgcagggggtggggagcactggaagccggagctggagggaaagatagtagacctggaaaaagaaaagactcaacttcaaaagaagcttcaagaagccttaatttcccgtaaggcaattctaaaaaaggcacaagagaaagagaaacatctgaaggaagagctcaaggagcagaaggatgcttaccgtcacctacaggaacagtttgatgggcagagtaaggaaaatgagaacattcgggccccgctaaggcaactccaagcaaaggagtctacagaccagcagctcccaggcactggccagcaggagcccactcacggttcagaaggcctttcactcgaaggcacagagcctgcttcagagtctgacttacacgcagctcagccttcgcaccctggagagacagcaactctccaggctaccgtttctgttgcccagattcaggaccagctgaaagaaattgaggttgagaaagaagagctggaattgaaaattagttctacaacaagtgagctgaccaaaaaatctgaagaagtattactactacaagaacagatcaatgaacagggcttagaaatccagaatttgaaggcagcgtcccacgaagccaaggcccacacagaacagctgaagcaagaattggaaagcagccaattgaaaattgctgacctggaacatctgaaaacattacagcctgaactagaaacactgcaaaagcacgtgggccagaaggaagaagaggtcagctaccttgttggacagcttggtgagaaggagcagaccctcaccaccgtacagacagaaatggaggagcaggagcgtttaatcaaggccctgcacacacagctggaaatgcaagccaaggagcatgaggagaggctaaagcaggtccaggtggaaatttgtgagctaaagaagcagccaaaagagcttgaggaagaaagtaaggcaaaacagcaattacagaggaaactgcaggctgccctcatctcccggaaggaggccctcaaggaaaacaagagtctgcaggagcagttgtcctcggccagagatgctgttgaacatctgaccaaatctctggcagatgtagagagccaggtttctgttcagaatcaagagaaagatgcactcctaggaaagttagcccttcttcaggaagaaagggacaaactcattgtagaaatggacaagtctttactggaaaatcagagccttggtggctcttgtgaaagcctgaagctagctctcgggggcctcactgaagacaaggaaaagctgatgaaggagctggaatccgtgagatgttctaagattgcagagagcaccgaatggcaagagaagcacaaggagctacagaaagagtatgaagttcttctgcagtcctacgagaatgtgagcaatgaggcagagaggattcaacacgtggtggagagcgtgaggcaagagaagcaggaggtgtacgcaaagttaaggagcgcagagtcagacaagagagagagagagaagcagctgcaggatgcagaacaggaaatggaggagatgaaggagaagatgagaaagtttgccaaatctaagcagcagaagatccttgagctagaggaagaaaacgaccgacttagagcagaggcccagcctgtaggaggagccaatgaaagcatggaagctcttctttcttccaatgccagcttaaaggaggaactagaaaggatcacattggagtataaaaccctttctaaggaatttgaggctttaatggcagagaagaacactctgagtgaagagactcgtaatctgaagcttcaggtagaagctcaggaactgaaacaagctagcctcgagaccaccgagaagtctgatgagccaaaggatgtcatcgaagaggtaacagaagccgtggtaggcaagtctcaagaacaagattccctgagtgaaaatgccaagcttgaagatgcagaagctactctcttggctaacagtgccaagcctggtgtcagtgagactttcagctcacacgatgacatcaataactacctccagcagcttgatcagcttaaaggaagaattgctgagttagagatggagaaacagaaagacagggagcttagccagactttggaaaatgaaaaaaatgccctactgactcagatatctgcaaaggatagtgagctcaagctcctggaggaagaggttgccaaaataaacatgctgaatcagcaaatccaagaggagctctccagagtcaccaagctgaaagagacagcagaggaggagaaagatgacttagaagagaggctgatgaatcaactggcggaacttaatgggagcatcgggaattattaccaggatgttacagacgcccaaataaagaacgagcaactagagtcagaaatgcagaaccttaaaagatgtgtgagtgaattagaagaagaaaagcagcagctggtcaaggaaaaaaccaaggtggagtcagaaatacgaaaagagtacatggaaaagatacaaggtgcccagaagggacctggcagtaaaatccacgccaaagagctacaggagctgctcaaggaaaaacagcaagaagtgaagcaactgcagaaggactgcatccggtacctcggcaggatcagtgccctggagaagaccgtcaaggccctcgagtttgttcacactgaatcccaaaaggatttggatgcaaccaaaggaaatctggctcaggccgttgaacaccacaagaaggcacaggccgagttatccagcttcaagatactgctagatgacacccaaagcgaagcagcaagagtgctagcggacaacctcaagttgaaaaaggagcttcagtcaaacaaagagtccatcaaaagccagataaaacaaaaagacgaagacctcttgcgaagactggagcaagcagaagagaaacaccgaaaagagaagaagaacatgcaagagaagctggatgctttgcacagagaaaaagcccatgtggaagacacgcttgccgagattcaagtcagtctgaccaggaaagacaaggacatgaaggagctgcagcaaagcctggacagcaccttggcccagcttgcggccttcactaagagcatgtcgtccctccaggatgaccgggacagggtgatcgatgaagccaagaaatgggagcagaggttcggtgatgccattcagaccaaagaggaggaggtcagactcaaagaggagaactgcactgctctaaaggatcagctccgacaaatgaccatccacatggaggaactgaagatcaccgtgtccaggcttgaacatgacaaggaaatttgggagtccaaggcccagaccgagctccagcatcaacagaaggcttatgataagctgcaagaagaaaataaagaacttatgtcacagttagaagaagctggacagctgtaccatgattctaagaatgaattaactaagttggaatcagaacttaagagtctcaaagaccaatcaactgacttaaagaactctttagaaaaatgcagagaacacgaaaacaacttggaagggatcatcaagcagcaagaagctgacatccagaattgtaagttcaattgtgaacaactagagactgacctgacagcctccagagagctaaccactcggctgcatgatgaaatcaatgtgaaggaacagaagattataagcctgctttctggcaaggaagaggcgatccaagtagctatcgcagaactgcaccaacagcacagtaaagagatcaaagaattagaaaacctgttgtcccaggaggaagaggagaatttgaccttagaagaggaaaacaaaagggctgttgagaaaaccaaccagctcacagaagcactagaaaccatcaagaaggagagccttgagcagaaggctcagttggattcctttgttaagtccatgtcctctcttcaggacgaccgggaccgcatagtaagtgactaccgacagctggaagagcggcacctttctgtgatcttggaaaaggacgagctcatccaagatgctgctgctgagaataataaactgaaggaggagattcgagggctgcgaggtcacatggatgacctcaactctgagaatgccaagctggatgctgaactgatccagtataggcgggacctgaatgaagtgatcaccataaaggactcgcagcaaaggcagctccttgaggctcagctgcagcagaacaaagagctgagaaatgagtgtgtaaagctagaaggaaggctgaaggggtcagaggcagagaagcagagcctgcagatgtccttggacgccctccaggaggagaatcaaggtttgtctaaagagatcaaaagcttcaaggagcagttgacggccttgcacgaggaaggtgccctagctgtctaccatgcccaactgagagtaagagaggaagaagttcagaagttaactgcggctctctcctcctctcagaagagaactgtggatctgcaagaggagttggtttgtgtccagaaggaggcaagcaagaaggtgagtgagattgaagataagctgaagagggagctgaagcatctccatcacaacgcagggataatgcggaacgaaacagagacagcagaagagagggtggcagagctggccagagacctcgtcgagatggaacagaagttgcttacggtaaccaaagagaataaggatcttacggcacagattcaggccttcggaaagtcgatgagttccttgcaggacagcagagatcatgccactgaggagctgagtgacctgaagaagaagtatgatgccagtctgaaagagctggctcagctgaaagggcggcaggacttaggcagagagagtgacgttctttcccaggctgcctttcccctgaccacctctgaaaacatctcgtcccgccttgagaaactgaaccagcagctcatatccaaagacgagcaattgcttcacttatcttcagaactagaaagttctcacaaccaagtgcagtccttcaccaaggccatgaccagcctacagaatgagagagatcacctgtggaatgagctggagaaattccggaagtcggaggaagggaagcagaggtctgcagccccttcagctgcctccagcccagcagaagtacagagcttgaaaaaagccatgtcttcactccagaatgacagagatcgattgctgaaggaactgaagaatctacaacagcagtacttacagatgaaccaagagatcaccgagctccgtccgctgaaggctcagcttcaggaatctcaagatcagaccaaagccctgcagatgatgaaggaggagctcaggcaggaaaacctctcctggcagcacgagctcgatcagctcagagtggagaagaactcttgggagctgcatgagagaagaatgaaggaacagtaccttatggccatctcagataaagatcagcagcttggccacctgcagaatctcctgagggaactgaggtcttcctcccagactcagattctccccacacagtaccagcgacaggcgtcctcagggacatcagctgccctcgacgggtcacaaaacctagtttatgaaacagactgtctcaggacccagctcaatgacagcttaaaggaaatccatcagaaggagctaagaattcagcaactgaacagcaagttctctcagctgcttgaggagaagaacatcctctccacccagctcagggacgccaaccagagtctccgtgacagccagcatcactacagtaacctcttcaaccactgtgccatcctggagaggcaggtgcagcagctgcaggctacggggccactaaatgcagatgttgctccaggagcaccccaggaaaaggatgggattcacataaagactgaaactgagaccacaggggaggaacagccaagcttttctgaagtccagcagcagctgtgcaacactaaacacgatctgagcgagctaaagaagctgctggaagaagagcgagaccaaagactgaccgccgaaaatgcactctccctggccaaggagcagatcagacggttggagcatagcgagtgggagtcagcccggaccccaatcattggcgcctgtggctctcaggagcaggtgctgttgatggatctcccaggcagtagctgtcggaggacccggagcagtgctggatggaagcgggttctgcgttctctctgccgttcccggacccgcgtgccactgctcgcagccatctacttcctaatgattcatgttttactggttctgtgtttcacgggtcacctataaacttgttacttgacaactctcgcacttgtaattccttatctgtagtgtcaggattgttgatcccagggcggcctctcgctttgagcccaccctcttggaaagtgcctgtgaaaagaggtggctgtgaggacaggcggcggtaagctggcctgccacatccgctctccttaaacacgtcggcttctgagatgtgccgtgttcactgcttcttcagatgatgcagatccacatcccgtgtggccttgcaggatgctgagagaggctttctagccgtgccaacaagatggttccaataaacacagtaatctggaatcc

SEQ ID NO: 4255 - DNA, 1115 bp, Rattus norvegicus
  Genbank Accession No. NM_138895
ctgtgagggtgtttcgacgcgctgggcggtttgttccttcatcgcattcgttaacaggtcaaaatgcaaatcttcgtgaagaccctgaccggcaagaccatcaccctagaggtggagcccagtgacaccatcgagaacgtgaaggccaagatccaggataaagagggcatcccccctgaccagcagaggctcatctttgccggcaagcagctggaagatggccgcaccctctctgactacaacatccagaaagagtcaaccctgcacctggtcctccgcctgaggggcggcatgcagatcttcgtgaagaccctgaccggcaagaccatcaccctggaggtggagcccagtgacaccatcgagaacgtgaaggccaagatccaggataaagagggcatcccccctgaccagcagaggctcatctttgccggcaagcagctggaagatggccgcaccctctctgattacaacatccagaaagagtcaaccctgcaccttgtcctccgcctgaggggcggcatgcagatcttcgtgaagaccctgaccggcaagaccatcaccctagaggtggagcccagtgacaccatcgagaacgtgaaggccaagatccaggataaagagggcatcccccctgaccagcagaggctcatctttgccggcaagcagctggaagatggccgcaccctctctgattacaacatccagaaggagtcaaccctgcacctggtcctccgcctgaggggcggcatgcagatcttcgtgaagaccctgaccggcaagaccatcaccctggaggtggagcccagtgacaccatcgagaacgtgaaggccaagatccaggataaagagggcatcccccctgaccagcagaggctcatctttgccggcaagcagctggaagatggccgcaccctctctgattacaacatccagaaagagtcaaccctgcacctggtcctccgcctgaggggtggctattaattcttcagtctgcattcccggcgggcactgatggcattactctgcactctagccatttgccccaatttaagtttagaaattacaagtttcagtaatagctgaacctctgttaaaaatgttaataaaggttttgt

SEQ ID NO: 4256 - DNA, 4758 bp, Rattus norvegicus
  Genbank Accession No. NM_138896
tggcgggtggaggatcgagcgctgttctcgctctggagccgctgcacatctcggaatcatttgcagcttattcactgtgtaaggaaaaaccaaattacatccataattctattgaactggaagcatagacgctgccatatatgtcacagtatacagaaaaagaaccatcagtaatggatcaagactccagcaaggctgcgtggcctagagcagcaggaggataccagacgattacaggcaggaggtacggaaggagacatgcgtatgtcagttttaagccatgtatgaccaggcatgaacggagcttgggtcgggctggcgatgactatgaagttctggaactggatgacgttgccaaggaaaacaccgcaggttccagttcattggatcaagtccatccttctttacccagtgaaactacagttgaaaaaagtgaaacagaaattcctacttgtggtccagcactgaatcaaagcacggagagcaacccatccgttgccacagtgtgtcatagtgaggaagtcagggagaccttagacagcagtacgaatcttcagaatcacgctgagagagagtgtacgccagcagtttgtaatgcctcaagtgtccagaatggaattgtgttggttcatactgactcttatgatccagacagcaagcatgatgagaatgactctcttcaactttgtgcccaagctgtggaaggtggtagacgtcagaaggtattaggcaatgcagtctttgagctggaaaatggagaggtagagagatatgctgatctgtgtccctcagttccctctctcagtggtgaaataagggaggagtctgaagagctaggttcagcactcttagagaaaaattctgctggcgatgcggaggctgtccatcaggatgggcaggaatttcagaggtcttctgaagacggcattgttagaaagaggcgacaagatgataccgatcagggaagacagacagaaaattcaactgaagatgcagactgtgttccaggccatgttgaacaaaatactagtgagagagccaatcaccatggaagttctcctgaacaggtagtgaggcccaaagttagaaaagtgatcagttcaagccaggtggaccaagagagcggttttaataggcacgaggctaagcaaagaagtgttcagaggtggagagaggctctggaagttgaggaatgcagttcagatgaccctataatcaagtgtgacgattatgatggagaccatgactgcatgttcctaaccccatcctactcaagagttacgccaagggaagcagaacgtcaccgtgcgacagcagaaaatggagccacagcttcaggaaggcaagaggctcgggaaaatgccttttggaatgcctgtggagagtattaccagctctttgacaaagacgaagacagttcagagtgcagtgatggggaatggtctgcttctctgcctcaccgattttctggcacagaaaaagaccagtcctcaagcgatgaaagctgggaaactctgccaggaaaagatgagaatgaacctgagctacagagtgatagtagtggccctgaggaagaaaaccaagaattgtctcttcaggagggagaacagacgtccttggaggagggggagattccctggttacagtacaatgaggtcaatgagagcagcagcgatgaagggaacgagcctgccaatgagtttgcacaaccagaagctttcatgttggatgggaacaacaacctggaggacgactcgagcgtgagtgaagacctggatgtggactggagcctatttgatggttttgcggatggacttggtgttgctgaagctatttcctacgtggatcctcagttcctcacctacatggcactagaagaacgcttagcccaggctatggagactgcactggcacacttagagtctcttgctgtagacgttgaggtggctaacccacctgccagtaaggaaagcatcgacggacttccagaaacccttgtcctagaagatcacaccgctattggtcaggagcagtgctgtcccatctgctgcagtgagtacattaaggatgacatcgcaacagagctgccctgccatcacttctttcataagccttgtgtctccatttggctacagaagtccggaacgtgccctgtgtgccgccgccacttcccacctgcagtgattgacgcatctgcagctgcttcctctgaaccagaccttgatgcctcgcctgcaaacgacaatgctgaggaagccccgtaagccgtcacggggaaatgagatcgaaattctatcacagtaaatctgcaaattccttctaaatctgatgtgcaaataattatatataaatatatttaaaatgctctatatagtatatgccgtagtttagaaagagaatattaacctttctaaactgaatttaggtttgcagaagatactaaacattttcaagctgaatgttgaagcagtgcatccattttctttagttgaacatggtgtccattgtaacgtcagtagtcatctctgtggcatacgtttctgttttgtctgaagtgctgccactaagagatcagaattaagctctcctttccacatcagatgtgaaaggagagcttaattctgatctctgtggcatacgtttctgttttgtctgaagtgctgccactaagagatcagaattaagctctcctttccacatcagatgtgaaaactgtgatcacaacagtagtacagtttggtttcattgaaaataaactgaattctaaagcatgctttttcactggtccctttgcttttgctacttcgagacctcttggtttatataacactgaggttaagattaaagcttttcagaatgccaggcaaagactagagttttgacccgaacacacacacaaaataaaaaaataaaaaataaattacatcttagatgtaaacttcctgaaactgtcatgtaataaactattcagtgaacgttggatgtttaaaggctagtaaagcatgtgaattatctgatgtgcttcatgctcggcacagtctcatgagcttggcctatgaaacactgtctaagccctcatgcagtctgcttctacttgttaaacactgaaggtccagaccagtcttggcatctgattaagaaattggatgtagttagctaaggtagtttgggttctactttaggagatctgaagatttgcacatggccatgtctgttacagcatcaccccagattagaaaggcacagcttttaggtggtcacacgagtaggcaagtctgtgcagacgctggtgtgataggtagcttacaggtgagccctgacatcagcacagggacaacggctcagcaggcccagcactggagcccatccgcgtgcacatctacctgccctgctcatccagttcgggaatatttctatagcttcccaaatcagcttcatctgatttgtgtaatatatctgagtatttatagtctttcttttttctccagtcttaaaaataaatgaattttcactgttggcacatttgaggcttaaatataagaaacctaacacttgcattctgatttttgcatatattgtaaatgtggctggtatttacagcgaatcctgtgtgtccttttatgggtaaaacaaaagtgaacattgcatgcaagtaatgtggtgaatttgtaatttaggggttttctggggcttctgtgactgtggatgcttaaattcaggccttaatgttgctctagctagcatgtttccttctaatgtacatagtcagcctgtatccactaatctctgcttgtcttctcctccgtggtcttcacaccgtatccactgatggtcagttagtgtcagaggtcacccaggttagcatcagttcccatgtgtgccgtgcggattgtgagccgtgtggttgcttggttggttttcttttatgtactttgattagctgtggcacttactgagtaaacttacgttgctgcagactgctgtgtaacaagccacgttttgtgtttagtcagtattacacacgggaccttgttttattcttctagatagcagctgtcccaaagaaaatatttcttctttgcctattaagatttagctattatctgccagttgttaaggggtttgattccaaactcaaccagagttgaacgtaagaaagctgctgtactcttgctgtccatctgttacgtcctccgttgttggctcctgactacgtacccacggctgctgaaggagacttgttttaatttgttttaaaaaggaaaatgaagttttaggactttgatggtggggaagctgacaagttcagaccccagtctgtcatttgctcttagcttggatccttttgaaaagttaagaatatatgaaggtaaattagaaaaagtaaaaatattgataaaatgtcatttatcttatgtctattttatgttgttatttggcctattaattttaattttttgaacattttcttatttcttgtaatatgaatgccgatatttaaagtttgactcacttgggtttcttttgtgtttcttagttgttatctctaagcctaactaacttttaagattatttgtgatatggatttatataagctgttaaatatatatgagctgttaaaatggaatgcaaggttttccaaagaccaggtctaactgtaatgattggtttattgttctacaatcccagcccggcattttccgtgtaaatcataaacaataaacaggatatactcagtgttcatttctaaaaaaaaaa

SEQ ID NO: 4257 - DNA, 2908 bp, Rattus norvegicus
  Genbank Accession No. NM_138900
ggaggtatcgaggaagagagaacagggaggtggggcggaggttcctcgcagagcctctggagccgcaggggcttcacggcatgaccagaagcaggagaggaggctgacccacttgttcccatcagctcctgaaggtgacactgagccctgggtggcccctcactgccaaagcagtcacctgtatttgtcagataaagacggccagcccggctgccctttacctccaagtcagagatccagagagccatgggcaaatcgccagagatgtggtgctttgtcttcttttctcttttggcatcgttttctgctgagcctaccatgtatggggagatcctgtcccctaattatccccaggcgtaccccaatgaggtcgtgaaaacttgggacatagaagtcccagaggggtttgggattcacctttacttcacccatctggacatggagctgtcagagaactgtgcatacgactcagtgcagataatctcaggaggtatcgaggaagagagactctgtggccagaggtccagcaagagtcccaactcccccactgtagaagagtttcaattcccatacaataggctccaggtggtctttacgtcagacttctccaacgaggaacggtttactggctttgcagcgtattactcagccgtagatgtaaatgaatgcacagactttacagatgtcccttgcagccacttctgcaataacttcattggtggatacttctgctcctgccccccagaatacttcctccacgatgacatgaggacttgtggggtcaactgtagtggggatgtattcactgccttgattggggagatcgcaagtcccaattatcccaacccatacccggagaactcaaggtgtgaataccagattcggctgcaggagggcttccgactggtgttgactatccggagagaagattttgatgtggaaccagcggactcagaggggaactgccacgacagtttgacttttgctgcaaaaaaccaacagtttggtccttactgtggcaatggattccctggacctctaactattaaaacccagagcaatactcttgatattgtctttcaaactgacctaacggggcaaaataaaggctggaagcttcgttaccatggagatcccatcccctgtcccaaagaaatcagtgctaattctatctgggagcccgaaaaggcaaaatacgtgttcaaagatgtcgtgaagataacctgtgtggatggattcgaagttgtggagggaaatgttggctcaacatcattctattccacttgtcaaagcaacggacagtggagcaattccaggctagagtgtcaacctgtggactgtggtgttccagaacccattgagaatggtaaagttgaagacccagaagacactgtattcggctccgtcatccactacacgtgcgaagagccatattactacatggaacaggaagaaggcggagagtatcactgtgctgctaatgggagctgggtgaatgaccagctgggtgtcgagcttccaaaatgtattccagtctgtggagtacccaccgagccctttaaagtacagcagaggatatttggaggatactctacaaagattcaaagttttccttggcaggtctactttgagtccccccgaggtggcggggctcttatcgatgagtactgggtgctgacggccgctcacgttgtggagggaaactctgacccagtgatgtatgtcgggtccacacttctgaaaatagagcggttgagaaatgcccagaggctcatcactgaacgtgtgattattcatcccagctggaaacaagaggacgacctgaatacacggacaaattttgacaatgacattgccctggtgcagctcaaagaccctgtgaaaatgggacccactgttgcccccatctgcctgccagaaaccttctcagactacaacccctcagaggttgacctggggctgatctctgggtggggccgaacagagattagaaccaatgttattcaactcagaggggcgaagttacccataacatctttagaaaagtgccagcaggtgaaagtggaaaacccgaaagcgaggtcaaacgactatgttttcactgacaacatgatctgtgctggggaaaagggtgtggacagctgtgaaggtgacagcggaggggcttttgctctgccggtccccaatgtcaaggaccccaaattctatgtggctggcctggtgtcctgggggaaaaagtgtgggacctatgggatctacacaaaggtaaagaactacgtggactggatcctgaaaactatgcaggagaatagtgggcccaagaaggactgatccgtagtaacaacacccctccaggactagcaaggtcatttttctcagatcctgggacggtcccattatttcaaaatgatggagagagggtgtgggagcatggttaacgttgaacatgattgtcaagaagcctgcttggaggcagagttgatcactgagccgtgttggttattcagttgctattgctaacaacatgcggaagcctttctgtcttgcttcatcccacagggatatcttaaacgatttccccctcatttaacccgcttgaaatccttattgcttacagtaaagcatgtttccaatctggttctggctgctcgagagcccagaaggagagggaaatttgagggtattttgtcatggaattcaggcatcgacaggttgtctgaaacactatgcagtcagggaacacagccttttttctaagtgagatttacccaatagctggaagtcagaattgactaccttagctttcctttgtgagttgtttcaatatgttccctagaaattagttttcttataatcctcctttgtatcatacaatgtaatgacttaataaaagagaaattgaacattg

SEQ ID NO: 4258 - DNA, 1903 bp, Rattus norvegicus
  Genbank Accession No. NM_138901
gcggcgtgctgatatgcctgaaatcccagctcgggaagcaagggaatgggaatcattgcaaattcgaggccagtatggtctctttatagtgagctcgggggtgggggtacacgcagcgagacactatcgcaaaataattctaaagtgcttccttttaagcacactggacggtaagaaagacaccagaccgcaaagttcgggaggacttcaccacagaatacggcggggtatgggtggaagtttccacgttcggccggccagcaatcttgttctccagcctcggcgctcttagccacggaacgcagtttcagcgggttcagttttcccgcagggagcccgagtccacccgcagccttccttcctgcgcaggcgcagtgccacttacccggcatggaagtggtgggtctcttgtgtgtggccgtggctgtcctgacttggggcttcctccgggtttggaactcagcggaacgaatgaggtctccggagcaggcgggcctaccgggagccggaagccgggcccttgtagtgatcgcgcacccggacgatgaagccatgttctttgctcccacgatactaggcttggcacgcctgaagcagcaggtgtccctgctctgcttctcctcaggaaattactacaatcaaggtgagattcgaaagaaagaacttctgcagagctgtgctgtcttggggattccaccttcccgtgtaatgattattgacaagagggagtttccagatgatccagaagtgcagtgggacacagagcatgtggccagcaccatcctccagcacatacatgccaatgccaccgacttggtggtgacttttgatgcagaaggagtcagtggtcacagcaaccatattgccttgtacaaagctgtgagggccctgcactcaggagggaagctgcctgaagggtgctctgtacttactctccagtctgtgaacgtgcttcggaagtatgtcttcctcctggatctcccctggactctactgtcgccccagggtgttctctttgtgctcaccagcaaagaagtggcacaggccaagaaagccatgtcctgccaccgcagtcagctgctctggttccgccacctctacaccgtcttctcgagatacatgagcgtcaactcgctgcagttgctctgaggcctgagagctgtcagctcctcggagcaggggagcagcagagcaggaagtcccctggccagacctgggctgactgacctgcttgaccagggagaccccagcaaagcagcctccgcctaacaggaaccacatggacaatgggtcaccccaacccagaaggctgcaagtccagaaccaagttatattggggtgtccttaggtaaacacttgagaatatagaagcagctccctagttcccaacaaccaaaaggctaaggagtctttcagatagcacctgaggcctacagctgagactcctggctttcctgtgatctgcctacctgatgttcccactgtgtgcacgagaaatgcccgtgtgtgacttcagttgtcctgctgctacaaaacctcgtggaactgaggtttacacattggaacatgaaactgggtaacctgaatgtgtgtcctgggcactgtcacatacttcactccaggttaaaaagatgcatagacttacaatgacttgagaattattctgtgccttttgtatttgttttactatctattcacgaatgaggaggatggaggtgacagtagcccagctggtagagcgtgtgcctaggtttggtctctagcacggcataaatgtgtgtgccacttgggttctggaggcaggaggatcagaaatccaaggtcatctttaactacacagcaagtttaaaaccaactcaggctaaaggagattcattccaaaataaatactacataaacatct

SEQ ID NO: 4259 - DNA, 2206 bp, Rattus norvegicus
  Genbank Accession No. NM_138905
aggaggcagagttggagttgggcagacgctgtggagagctagctgcaggacgctgcggagttgcagggctccgcgctgctccattcattaagtagctgcggaggatcgtggccggacgccgacgctgcccactcgcaaacttcagcacgcagacgcacgccagcccggcgcgtccggacagcacagttttgcaaaagttcctgctcgggatttggctctcttccctttggactagcgaacagtttggggttgagaggaaagcagaggcgctcagggggaaacctacccgcgtctgcagttggaactactcggccgggctgtacactcgccgccgcgtcccgagcccgcagatccgctcctgagcagcggcggcccgcagcgccccgggaggctccccgcagccagcgccatgcaaagctacaagtacgacaaggcgatcgtccctgagagtaagaacggcggcagcccggcgctcaacaacaacccgaggaaaggcggcagcaagcgggtgctgctcatctgcctcgacctcttctgcctcttcatggcggctctgcccttcctcatcatcgagacaagcaccattaagccttatcgtcgagggttttactgcaacgacgagagcatcaagtaccccctgaaagtcagcgagactataaacgacgccgtgctctgtgcggtggggatcgtcatcgccatcctgcggatcatcacgggggaattctaccggatctattacctcaaggagaagtcccgatccaccattcagaacccttatgtggccgctctctataagcaagtgggatgcttccttttcggctgtgccatcagccagtccttcacagacatcgccaaagtgtccattgggcgcctgaggcctcacttcctcagcgtctgtgaccctgatttcagtcagatcaattgctccgagggctacattcagaactacaggtgccgaggagaagacagcaaagtacaggaggccaggaaatccttcttctcgggccacgcctccttctccatgttcacaatgctgtatctggtgctttatctacaggcccgcttcacctggcgtggggcccggctcctccgccccctcctgcagttcactttgctcatgatggccttctacacgggattgtcacgtgtatctgactacaaacaccatcctagcgatgtcctggcaggatttgcccaaggagctctggtggcctgctgcatagtgttcttcgtgtctgacctcttcaagactaagacgaccctctcactgcctgcccccgcgatcaggagagagatcctgtctcctgtagacatcatggacaggagcaatcaccacaacatggtgtaggtgctgcggcctccagagcactttctctgaagcgactgcttgacagcatgtccctgctgctctccaatctcatcagacagtagaatgtagggaaaagctttttgcccgattggattttgaaaacatttaaagaaaaaaaaaaagtccttaccttgtggccttccaaaataggttgtttgcctgtgtggagacaacagtgccggagtcctgagtgctggctgcacagctggctaagtgttcatgttctagtgagcacgggcttgtcaggagcaaaacactaggataattgagcagaggctgtggtcaccttttgtgacccgagaaatcccaggcagaatagcgggggcgcttatgtagcacgcaaggcctgaaccagcaccgaatcagcccctctgcctgccccactctactgtgactttgattcaaggaagtttttgcgctttgaaataccgggaatgaacacacagtttttcagtcgagggatcagatcctgaatccaaaccccatgtcctgaggcctctgtcatctctccatccccaggctaacaaccacagtcccctcacttttagagacttagagaccctttgtggaagagtgaacttcacaaatagcacaagttcagaagacatgtagggtgtcttctcacacaccacactgtgacgcacgcggaactgccattgcggggtcaatcaccaggcacttgcacgtgtagaaacccgtagactttggttactgctatatcccccttgagatccttgctgggtgcctaccaggatttcatgtgagggccagggatgcataggcatggccaacctttggtggatcaaaagagcctcagtagagagacagggagggagg

SEQ ID NO: 4260 - DNA, 1711 bp, Rattus norvegicus
  Genbank Accession No. NM_138907
cgggcctacggctcagtctaaggactgcaaataggcagctggccactagaggatctctaacttttcctacgaaactgagggctgaagtcaaagatacaaaatggtggcctcgtctttcgctgtcctgagagcaagcaggttgtgccaatggggttggaagagctggacgcagctgtcaggtcctccgccgctcagcaccggtggccggaccacttttgcgcggacaaatgctacgctgagcctggagcccgggagccgcagctgctgggacgagccgttgagcatcaccgtgcgcggcctggcccccgagcagcccgtcacgctgcgcgcggccctgcgtgacgagaagggcgcgctcttccgagcccacgcgcgctaccgcgccgacgccggtggtgagctggacctggcgcgcgctcccgcgctgggcggcagcttcacggggctcgagcccatggggctgatctgggccatggagcccgaacggcctctctggcgcctggtcaagcgcgacgtgcagaagccttatgtggtggagctggaggtgctggacggacacgagcccgacggcggtcagcggctggcacaggcagtgcacgagcgtcacttcatggctccaggggtgcggcgcgtgcccgtgcgcgacgggcgggtgcgcgccacgctcttcctgcccccagaacctgggccctttcctgaaatcatagacctttttggagttggaggcggccttctggagtaccgggcgagtctgctggctgggaagggttttgccgtcatggctctggcttattacaactacgacgacctccccaagaccatggaaaccatgcgcattgagtactttgaagaagccgtgaactacctgcgtggccaccctgaggtaaaaggaccaggaattgggctgcttgggatttccaaagggggtgaacttggccttgctatggcctccttcctgaagggcatcacggctgctgttgtcatcaatggctccgtggctgctgttgggaacaccgtatgctacaaggatgagactataccccctgtgtcccttctgagagacaaagtcaaaatgaccaaagatggtctcttggatgtcgtggaagctctgcaaagccctttggtagacaagaagagcttcatccctgtggaaaggtctgacacgaccttcctgttcctcgttggtcaggatgaccacaactggaagagcgagttctatgccagagaggcctccaaacgcttgcaggcccacgggaaagagaagccccagatcatctgctacccagaagcagggcactatatcgagcctccttacttcccactgtgcagcgctggcatgcacctcttggtgggtgctaacatcacctttggaggggagcctaagcctcactctgtggcccagttggatgcatggcagcaactccagactttcttccacaaacagttgagtggtaagagttaggaggtgccccctaaaatataacctgttatgtggtggtttggggaaaaacccaaatatcagaatgccacttcagtttagttcatttgaacacatactaatttttttaagtttctttcttccttcctttctttctttctgttttttttttttgttgttgttgttgttgtttgtttgtttgtttgagacagggtttgtctgtttacccctggctggcctggaacttgctttgtagaccagaggctaggcctg

SEQ ID NO: 4261 - DNA, 342 bp, Rattus norvegicus
  Genbank Accession No. NM_138910
atgtcggcgtcggtagtgtccgtcatctcccggttcctggaggagtacttgagctccactccacagcggctgaagttgctggatgcctatctcctttatatattgctgaccggggcgctgcagttcggctactgtctcctcgtgggcaccttccccttcaactctttcctctctggcttcatctcttgtgtgggcagcttcatcttagcggtttgcttgagaatacagatcaacccccagaacaaggcggatttccaaggcatctctcctgagcgagcctttgctgattttctctttgccagcactatcctgcacctcgtcgtcatgaactttgttggctga

SEQ ID NO: 4262 - DNA, 780 bp, Rattus norvegicus
  Genbank Accession No. NM_138919
atgctaccaagtacttctttgaattcttcgatgtacgggaatggagctttaaattccagggatgcagcaagacacacagctggagcaaaacgctacaagtacctcagaaggctttttcgctttcggcagatggactttgagtttgcggcatggcagatgctctacctgttcacctcccctcagagggtttatagaaactttcactaccggaagcaaacgaaggatcagtgggccagagatgaccctgccttcttggtcctcctaagtatctggctctgtgtgtccaccataggatttggctttgtgctggacatgggattttttgagacaataaagctgctcctgtgggttgtgttcatagattgtgtaggtgttggccttctcatatcaactttaatgtggttcatctccaacaagtacctggtgaaacgccagagcagagattacgatgtggagtggggctacgctttcgacgtgcacctgaatgctttctatccgctcctcgtcatcctgcatttcatccagctcttcttcatcaaccatgttattctcacagacacgtttattggatatttagttggaaataccttatggttgatcgcggttggctattatatctatgtgaccttcctgggatacagtgcattgccatttttgaaaaatacagtggtcctgctctatccatttgcacctctcattgtgctgtacggactatcactggcgctgggatggaactttacccacacgttgtgttccttctacaagtacagagtgaagtga

SEQ ID NO: 4263 - DNA, 3484 bp, Rattus norvegicus
  Genbank Accession No. NM_139042
atgttacccatggcttccagggcacgctctgagcctccactagaacataggttctatggcggggctgaaagccatgcaggtcattcgtctctggttttgacgctctttgtcgttatgctaatgacttgtcttgaagctgctaagctcaccgtggggttccatgccccctggaacatctctcatccatttagtgtgcaaaggttgggggcaggcctccagattgctgtggacaaactcaactcagagccagtgggtcctgggaacttgagctgggagttcacgtacaccaacgcgacctgcaatgccaaggagtcccttgcagctttcatcgaccaggtccagagagaacacatttctgttctgattggaccagcatgcccagaagcagcagaggttattggtttactggcctccgagtgggacatccccttgtttgacttcgttggacaaatgacagcgctggaggatcacttctggtgtgacacctgtgtgacacttgtgccgcccaagcaggagatcggcactgtgcttcgggaaagcctgcagtacctgggctgggaatatataggggtgtttggaggctcctcggcaggttcctcctggggagaagtgaatgagctgtggaaggctgtggaggatgaactccagctccatttcaccatcacagccagagtgagatacagcagcggccactcagaccttctgcaggaaggcctcaggagcatgtcttctgttgccagggttatcattctgatctgcagctcagaggacgcaaagcacattctgcaagcagcagaggacctgggactcaactcgggagaatttgttttccttctcttgcagcagctggaggacagtttttggaaggaagtactggcagaggacaaggtgacacgctttcccaaagtctatgagtcggtgtttctcattgctcccagcacctatggagggagcgctggagatgatgacttccggaagcaagtctaccaaaggctgaggaggccaccctttcaaagctccatctcctcagaggaccaggtgagcccttactctgcctacctgcatgatgctctcttactctacgctcagactgtggaggaaatgatgaaggctgagaaagacttccgggatgggcggcagctgattagcacactgagagctgatcaggtcacactgcagggaatcactggtcctgtgctcttggacgcccaggggaaaaggcacatggactactccgtctacgccctacagaaatctggaaacggatcccgcttccttccttttcttcattatgacagttttcagaaagtaatcagaccctggagggacgacttgaatgcctcagggccccatggctcccatcctgaatacaaacccgactgtggattccatgaagacctttgcaggacgaagcctccgactggagcaggtatgactgcatctgtgactgctgtgatccccacggtgacactgctggttgttgcctcagcagctgccatcacaggtctgatgttatggaggctgagaggaaaagtgcagaaccaccctggagacacctggtggcagatccattatgacagcatcactcttctgcctcagcataaaccgtcccaccgaggcacacctatgtcaagatgtaacgttagtaatgcatctactgtgaagatttctgcagattgtggctcctttgccaagactcaccaggatgaagagctcttctatgcccctgtggggctttaccagggaaatcatgtggccctctgctatatcggcgaggaagcagaagcacggattaagaagccaactgttctgcgggaagtctggctgatgtgtgaattaaagcatgaaaacatcgtccccttctttggtgtttgcacagaaccacctaacatctgcatcgttacacagtattgcaaaaaaggaagtctcaaggatgttttgaggaactccgatcatgagatggattggatattcaagctctctttcgtgtatgacatagtcaacggcatgctgttcctccacgggagcccactgaggtctcacggcaacctgaaaccttccaactgtctggtagacagtcacatgcagctgaagctggcaggattcgggttgtgggagttcaagcacggcagcacctgcaggatctacaaccaggaggccacggaccattcagagctctactggacagccccagaactgttgcggcttcgggagcttccctggtccggcaccccgcagggagacgtttacagctttgccattctcctgagggacctgatccaccagcaggcccacgggccctttgaggaccttgaggcagctccagaggaaatcatcagctgcattaaagacccccgggcaccggttccacttcggccgtccctgttagaggataaaggtgacgaaaggattgtggccctggtgagggcatgttgggctgaatctccagagcagaggcctgccttcccttccatcaagaagacgttacgagaagccagtccaagaggcagggtgagcatcttggatagcatgatgggcaagctggaaatgtacgccagtcatctggaggaagtagtggaggagcggacctgccagctggtggcagagaagagaaaggtggagaaactcctgtccaccatgttgccaagcttcgttggagaacagctaatagctggaaagtccgtagaaccagaacattttgagtctgtcaccatctttttctctgacatcgtgggattcacaaaactatgttctctcagctcccccttgcaagtggtgaagctcctcaatgacctgtacagcttgtttgatcacacaatacagacccatgacgtatacaaggtggaaaccattggtgatgcctatatggtggccagtgggcttcctatccgaaatggagctcaacacgcggatgagattgccaccatgtctttgcatttactcagtgtcaccaccaacttccagattgggcacatgcctgaggagagactcaagctccggataggcctccacacaggtcctgtggtggctggtgtggtgggaatcaccatgcccaggtactgtctgtttggagacactgtgaacatggcctccagaatggaaagcagcagtttgcctctccggattcatgtttctcaaagcactgccagagctcttctagtagcaggagggtaccatcttcagaagagaggcaccatttcagtcaagggcaagggagaacagacgaccttctggctgacaggcaaagatggcttcgctgtcccgctccccgagtttactgaggaagaagccaaagttccagagatattgtgaggttctttcaagatgtttgtggagccccactaatgtttgtgggtaccctcttggtggggaggggagatacatctgacattcctcttcctctgagttgtagtactcggcaatgaatcgatgtcccactaaaaaaaaaaaaaaaaagggccggccggccgcaaaaaaaaaaaaa

SEQ ID NO: 4264 - DNA, 1046 bp, Rattus norvegicus
  Genbank Accession No. NM_139081
tttgcgaacggcgagcagcggcggcggcgcgggaagtgcagcggaggtttttgctggtttcggaccccagcggccggatggtgaaatcctccctgcagcggatcctcaacagccactgcttcgccagagagaaagaaggggacaaacgcagcgccacgcttcacgccagccgcaccatgccgcttcttagtcagcacagccgcggcggctgcagcagcgagagttctagggttgcccttcattgctgtagtaacctgggtccggggcctcggtggtgctcctgatgtccctcacccacccctgaagatcccaggtgggcgagggaacagtcagcgggatcacagtctttcagctagcatcctgtactccgacgagcggctgaatgtgacagaggagccgacgtctaacgacaagaccagggtcctgagcatccagtgcacgctcacggaggccaagcaggtcacctggagggcggtgtggaatggtggtggcctctacatcgagctcccagctgggcctctgccagaaggcagcaaggacagttttgcagctctactagagttcgcagaggagcagctccgggccgaccacgttttcatctgcttccccaagaaccgtgaggacagagccgccctactccgaaccttcagctttcttggctttgagattgtgagacccgggcatcccctcgtccccaagagacccgacgcttgcttcatggtctacacgctggagagagaggacccgggtgaggaggactaggtgccagccctgcccagtgtccctgcaccctctcccgggtttgtccacatgtcatgattgtgcagaataaacgctcactccattagcggggtgcttcttcgagctgaatgctgtgtttgtcacactcaagtggtggctttaattctaaataaaggtttctattttacttttttattgctgtttaagatggtcaggtgacctgttttagagcagcctcctttgaagtctggaaaaatggtgtcacctcccctggctcaaacctaataaataaagtgatctcgttc

SEQ ID NO: 4265 - DNA, 438 bp, Rattus norvegicus
  Genbank Accession No. NM_139086
atggcatatcacgaaaaatggtccattgtcaccatgtccccgctgtgcctgctgttgctggctttagccctggtggctgtccccggtgcccgaggcgcttgtccagtgcccgcagacctgaagaagtcagatgggacgcgcacgtgcgccaggctctatgagaacagtgacccctactatgacaactgctgccaggggcctgaactgtctgtggatccaggcaccgacctgccctacctgccctcggactggtctaactcggcatcttctctggtagtggcccagcgctgcgagctcaccgtgtggtctctccctggtaaacgtggcaagacacgcaagttctctacgggtagctaccctcgactggaagagtaccgcaaaggcatctttggaacctgggccaagtccatctctggcctctactgcaagtgctattga

SEQ ID NO: 4266 - DNA, 1257 bp, Rattus norvegicus
  Genbank Accession No. NM_139087
cacgaagccggagccccagacgcgcacaggccgccgcagcagctccggtgttcagcaggatgtcccggtggctaatgcaaatgttgatgctgcccctattgctgctccctttgggtcaagctgcccccaaggatggagttgcaaggctggaccctgaggcacaacagcagctcacaaccaaccccttccagccaggccctgagcagctccgacgtctgcgggattatctcaagggactggagaagatggaagaggaccctgaacaaatgaaccgggagcaagtcctgctatatctctttgctcttcacgactttgaccagaacggacaactggacggcctggaactcttgtccatgctgacagcagctctggcccctggagctgcacacttccccatcaacccggtgatcctggtagtagacatggtgcttgagactcaggacctggatggagacgggctcatgactcctgcagagctcatcaacttcccaggagaagcccccaagcgcgcagagtcccttcccccagctctccaggagccacaacctgccggaagtcagccgcttttagccaacagtccgctgcaatcagaaacccagcaatccctggggactaaagaagaaattacaagtcaggtagaggccaaaagggccttggagcctgaacaggaggctggacatcacatagagactaaagtagatgctctaagccctgaaggggaggctaggggtcaggcagagtctgaaggagatgccccaggtccccgagaggatgctgagagacaggtggagagcaaggacaacgaaggggaagccaaagacctgccagcggaaacactagagacccaaaacactccaaatgtggttgaggctcatagcatccaactggaaaacgacgagatatgagctagacacacaggctcatgcccctcaggatctcagtgcagaacagaagcatcaagtgtgaatacagtgggtctggagccacctctgacatgggtatggtggtccaagctcgtactcccagaagcactgagagctccaggctagcctaggccacttagcaagtttgaagccaggctgggctacttcgtgaggccctgtcttgaggaggggaaaagaaacgctctcccacgtctcctttctggccctcagtaggaagcaggacttttcttcgcagctcaggggagaccacaagctgagaggcagatttcaggccccaaacaatcaataaaaaacaaaatggatttgtctccat

SEQ ID NO: 4267 - DNA, 1133 bp, Rattus norvegicus
  Genbank Accession No. NM_139089
cctcggctgagctgcattccaatcccagctacatccggagcccagctacattcgagcccagccacatcccgagccaaccttccagaagcaccatgaacccaagtgctgctgtcgttctctgcctcgtgctgctgagtctgagtgggactcaagggatccctctcgcaagaacggtgcgctgcacctgcatcgacttccatgaacagacgctgagacccagggccataggaaaacttgaaatcattcctgcaagtctatcctgtccgcatgttgagatcattgccacaatgaagaagaacaatgagaagaggtgtctgaatccggaatctgaggccatcaagagcttattgaaagcggtgagccaaagaaggtcaaaaagagctccgtaactagagagaagccactcgccacagtgctgagaccgatggacagcagagagacggtctctccacctccctttacccagtgtgcggctagtcctaactgtccctgtttctcctgaccatggtcccatcagctggtactcccactacagcgtgatggacaaggcctggtcctgagacaaaagtaactccagcagcaaggcttcccaattctctaagagctggtccgaatcttccctcaggcagctatgacggctctcctagctctgttccgtaagctatgtgcaggtactaatctcttcagcatgtgccatgccccagcctgctccacacaccctccttctccctagctctaagctcatcagttctgagttcacctgagctcctttatttcaaatgcagtccaggtgagatggcaaatcaagtttgtcagaacaaacttaccaccaccttcccaagggaatttcataactcagaatactcacaggaacctagacatgcatgtttaaatattatttaatgaccgactgtacaaagtggaactcctagatgtattttttgtacgattttcattgtatatgtaagaacttgtgtggttaagtatgtatcaatgggtagttaaagtttacataggcaaatgctttgaatgctacatattacaagatgtgttggatggttttcaaaataaaatgtactgtattgaatgtagtatgagacaaaaaagtaataaagtaataataactgacatga

SEQ ID NO: 4268 - DNA, 5221 bp, Rattus norvegicus
  Genbank Accession No. NM_139093
ggacagaggcaggatcgtctaggagcgtccgggaggcgcgaggtttccggaggtgaactccaatgtgcagccatggatgatgacaatttggatgagcttgtggctcacagccctgggccagatggacctccacaagttggctcctcagaactagccagtgatgctgaagaaagcagcaatggccacagtgaagactctgaagatgatacaggcagtgagcaggatgatgacacagatggggaggaaacagaggggctgtctgaagaggaagacccagaagatagatctggttctgaagattcagaagatggaatagaagtgccaacagcagcagtggagactcaaaggaagcttgaagctagcagtacacccaattctgatgacgatgcagagagctgccccatttgcctcaatgcatttagagaccaggctgtgggcaccccagagacctgtgcccattatttctgcctggactgcatcattgaatggtccaggaatgccaattcctgtccagttgatcgaacaatatttaaatgtatttgtattcgagcccaatttaatggtaaaatcttaaagaagattccagtggaaaacactagagcttgtgaagatgaggaggctgaagaggaagacccgaccttttgtgaagtgtgtggcaggagtgatcgtgaggaccggctcctactttgtgacggctgtgatgctggatgcagctcctgtgagtgatgaggaggtctccttgctactggctgatgtagtgccaaccaccagcagacttcggcctcgagtaggcaggacccgggccatcgctaggacacggcagagtgagagagtgagggcaactgtgaaccggaaccggatctcttctgccagaagggtccagcatgtgccacggtacctcatgtcttctctgctggatgaaactattgaggctgtcgccactggtctgagcacagctgtataccagcgtcccttgacacctcgtgttcctgcaaaacggaaaaggaaggcagggagacgaaagaaagtactgggaaggaagaaaacccggtccaggtcatctgtgaaaagtaagagtgggggtacaagagccaagaaacggcagcaccgtgtgaggaggacgaaagggaggaagctgaagaacgaagtcacagctcgttctcgcattgcacgaacactaggcctccgcaggcctgtccgtggcaccagcatgccatcagtatacaagcctgtggacccctctcttgggctgatgagggcagatattggagcagcttctctgtcactgtttggagatccctatgcactagacccttttgacagcaatggagaacagtctgcagatccgccttcccctctgagtgccaagaggagagtgctgtcccgctcagccctgcagtctcaccagcctgtggccagacctgtcgccatgggactcgctaggaggcagctccctgctgtggccccagagcccagtgtggaggaggcccccgtccctgacctgctggggagcatcctgtgtggccagagcctcctgatgatgagcagtgctgatgttgtcatacaccgggatggctctctcagcgccaagagggcagctcctgtttctcttcagcgaaattctgtgactcaatccagagaagagtccaggctcagagacaacctgcagcctggggcactaccttcagagagcgtatccggtggactcataggagacagacgaccaaactcagggctgagctgtggggacagaacagctctgcgctgtctccctgcccaaatagtgcagacacctgtgaggtcagattcatcagtttcccctcgttcaggtctgtctgggaacctttcagatgagagcagacctaaatggaaacacagtaacagcccccgactcaatggctccaatgtacgggttggttctgcttcaactaagaccatgactcattctaactttccatctaaaaatatagctcctgggcatcctcagaaaacagatcccaggagacctgatttctccaagctccccaggataccaaagatccgcagggatggcagtaatagcacacaggaccaggccccagccagcggtcagactgtcgagctccccagcgcatgcatcagccgcctgactggcagggaaggccctgggcagccaggacgaggccgggctgacagtgagcccagcagcaggggtccccaggagactggctcacacacaagtggttctcgacctcctgcgcccagctcccatggcaacctagctcctctagggccctcaagaggaaagggcattgggtctagctttgaaagcttcaggatcaacatccctgggaacactgcgcactgcagcccgctgtccagccctggattctgtaacacattccggccagtagacagcaaggtacagaggaaggagaacccttcacccctcttctccatcaagaagccgaaacaactcaaaagtgaaatctatgacccctttgatcccactggctcagactctagccctcctagcagcagcccagagagtcttggtccagaccttctgccctctgagatcacaagaactatctccatcaatagcccaaaggccccagccttccagactgtgcgctgtgttacctcctacagagtagaaagcgtctttgggactgagatggaccctgatccccagccccctggggagcctgtctctggcatgctggagttacttggcaagggacctgctgagggagcctctgatttggagcaagaaggactaggtgaaatagagcctacagaaattcagggctcctcagcccgagcacagaggccatccccaccagacccttgggatgatgaggatggagtgtcctgtacgcccttctttggctctgaggagcggacagtgacatgtgtgactgtcgaggagccaagtgttccaagcccagatgctccacagataaccacccacagaattgtggagttcagagcctcatcccgttcccgctccacctccagctcccgaagcaggaagaaaacaaagaagaagaagaaggttgccagagagcaccagaggacacgatccagcactcgctcaggctccagggacaggacttcacgctcagtatctccatttaccgaggaacacaccaagagacacagagccaagactaagagccggaggtcttccagtgaccgtgccagcagccaggacagagcaaagaggaggaaggacagagacagggagcatagacggggtccctggggtcatggcagatgctggaggaagtccaggtcccgctcagggagtcctggcagttcctcctgtgagcgccatgagagtaggagacggaagaggcggcattcagggtccagatctcgtggcagggatggctcaccacacagcagcctggagagggaccggagacataaacatcgggagaggagccgagagcggatggacaagaaggagagtatgactcggtcccgggagagaaggaggtggcggtctcggtcacccagtgtggagcataggacacgaaggccacattctcgtgagaagcatccccattccccagagaagaagggggctgtgagggaggtttccccagcccctgctccacagggggagccacggcaggatggagaccactctaccaagcctccagtctcagaagtaagtgtcttgccagaggtagtaagtgtcctgccagaggtggttgtggctgacctgaaccctccagaagtccctcctgtcctcgcagagtcagtttcatgtgtgcctgaggaccttgattatggtgattctgtggaggcaggccacgtctttgaggatttttcaaatgaagccatcttcatccagctcgatgatatgagctcacctccttcccctgagagtacagactcctcccctgagcgagacttcctaccaaaccccatactgcccccagccagccttccacaaaacagtactttacctgtcacccagagggaggtgttaccaattcacagtgaagatatctcaaagcctgcaccccagccattggccccttcagaccagtgcctgctcaggcaggacactgtagagaccactgctacaactctgagcaccccaggtgtgttgcccatgggaaaggacagtcctttgctgagtgggagaggatgtgaagtggtcaggcccaaggatgctgtggccccggccccactgctgcgatccagaaccctggtgaaaagagtcacctggaacctgcaggaagcagaggccagcaccccagccctggacagagatccaaggacaccacttcagaggccccagaggccccaggaaggagactgggatgcagaggacagggccctcataggatttcagcaggcaccattctccgagctgccccctcccatccacgtgctccaggagtctgggttacctgatgcagatccctctcagccccctggtgttcccagggcagaagggcctccagctgttgggactctgcactcagcagggggtattcttgcccaggtttacagccccaacatgccaccacccctggctcagccctcaagcatcccgccctatgcactggtcaaccagccctcagtccagttgattctgcaggggacccttcccctagcaggctgtggtgcagcacagaacctggccccagtgcccactatgccagctacagcctcagagctagctgttccaaccaccaacaactcagaagaaaggacggctactcccaaaacagctgctgagaagaccacaaaggaggagtacatgaagaagctgcacatgcaggaacgggctgtggaggaagtgaagctggccattaaacccttctaccagaagagagaggtgaccaaggaggagtacaaggacatcctgcgcaaagctgtgcagaagatctgccacagcaagagtggcgaaatcaaccctgtaaaggtggccaacctggtgaaggcctatgtggacaaatacaggcatatgcgcaagcacaagaagactgaagctggagaggagccacccactcaaggtgctgagacctgaggctagccactgtgtggggaggcgtccccagtaggaaagaaatggggctaccagcactcctgcctctgaggttctcatgatacctgtctgcacctgtcttgcttacaattgaaaactggactttttatatgtatattatagatacactgtttccattgtggtctaatttatcaaagatggcttatcttt

SEQ ID NO: 4269 - DNA, 4794 bp, Rattus norvegicus
  Genbank Accession No. NM_139094
cccgtgggaggaagaggaaggaggagaagggggtggagagtggagggggccgaagcttgagtgtggagtccgcttccgagcggggcggagaaacagagaaggcgccgcgccagcccctcccccaccaccgacccgccccgacggcctcggtcctgctcgctgcgcccgccccgcgaccatgccgggacctcacgggcgctgaggagcgtctccagctagccgtgctccgcggccttctgggcccgtcgcccgcccttccgcacgcaacgcgcccagccgccgcctcttccttcgccgggccccgggcctctgcgcagacaacatggaggccgtgaagaccttcaacagcgagttgtattcgctgaatgactataagccacccatttctaaagcaaaaatgacccagattacaaaggcagccatcaaagctattaagttctataaacatgtggtacagagcgttgagaaattcattcagaaatgtaaaccagaatacaaggtacccggactgtatgttattgactccattgtgcgacaatcccggcatcaggttggtcaagaaaaggatgtgtgtgcacccagatttagtaataacatcattagcactttccagaatttatatcggtgcccgggggatgacaagagtaaaatagtgagagtattaaacttatggcagaagaataatgtttttaagagcgagattatccagcctctcctggatatggcggcagggattcctcccccagttgtcaccccggttttggccagcaccactgtagccatgagcaacactccaggaacacctgtgacacctgttactccagccaatgtggttcaaggcctacctgatccatgggtatcgcagataacaaacacagacacactggcagctgttgcccagatcctacaaagtcctcaaggtcaacagcttcagcaactaatacagaccttacagatacaacagcagaagccccagccctctatccttcaggctttggatgctggccttgtggttcagttgcaggcactcactgcacagcttacagctgcagctgctgcagccaacacacttactcccttggaccagggagtctctttcaacaagaagttgatggatagatttgattttggggaagattctgagcatagtgaagaatccaaaaaggaaattcctactcctcaactctctcacgtttctgagtctgtgaacaactccatcttccatcagatagcagaacagctgcagcagcagaacctggagcagttgcggcagcagctcctggagcagcagcagcctcagaaggtaactcctcaggacagccaggagggagcatttggctctgagcactcagcttcaccctcacaagggagtagccaacagcattttctggaacctgaagcaaatttagatgattccatagacattcagcaacaggatatggatattgatgaagggcaagatgttgttgaagaggagatctttgaaccagaagctaagaaagtagctgttcgctcaagatcaagaactcattcacgatctcgatcaaggtcaccaagaaaacggaggtccaggtcacgctctgggtcccgaaagcgaaagcataggaagaggtctcgctcccgctccagagagagaaagagaaaatcctcacgttcctattcaagtgaacgcagagccagggaaagggagaaagaacgccaaaaaaagggcttgcctcctgtcagatcgaaaacgctaagtgtatgcagcactactctctgggttggccaagtggacaagaaggctacacagcaagatttaaccaacctttttgaggagtttgggcaaatcgaatccattaatatgattccacccaggggctgtgcatatgtctgtatggttcatcgacaagattcatttcgggctctccagaaactgagttcaggatcctataaaattggttccaaggtcattaagattgcctgggctttgaacaaaggtgtaaagacagaatacaaacagttctgggacgtggatcttggagtcacatatataccctgggaaaaagttaaagtagatgacttggatggctttgcagagggaggcatgattgatcaggaaactgtaaatgctgaatgggaaactgtgaaaacctcagaacccgttaaagagactgtccagacgacacagagtccagctgcagttgagaaggagacagtggtcacaacgcagtcagaggttttccctcctcctgtcaccatgctgcagattcctgtagcaccaaccgttcctgcagttagcttagttccaccagcgtttcctgtgtcgatgcctgtcccccctcctggattcagccccatccctccacctccttttctacgagcaagttttaacccttcacaaccacctcctggttttatgccacctccagttcccccacctgtggtacctccccctgcaatcccacccgtagtaccaacatctttagtgcaaccaccattgtctatgaccccagaaactgtgaaagatgttggatttggcagccttgttttaccaggtggttctgttgctggcaatcttgctccttcaactctaccagctggaaatgtttttaatcctcccagtaaagcagagcctgaagaaaaagtacctcaccttacagaacaccagattccttctggtgagaataccagaccagtgattccaagtgatattccaagcagtgctccaatgttagcacagccgcctggggcctcaaacacctctgggatcctgtgcgtgcagagaccaaacgtatcaagcaattctgaaattctgggggttcgtccagccaatgtttccaacagtgctgcgattatgggagcccagccaccaaatatgctcaataactctggaattttgggcatacagccaccaaatgtgtccagtggctctggacttcttggggtactgcctccaaacttgcctaacaactctggacttgtaggactacagccaccaaatgttacaaatcctgctggacttttgggaacacagccaccaattggacctcaaaacttaccccctttaaccatccctgctcaaaggatgcctgcgttgccaatgttagacattcgtccgggactgatagcacaggctcctgggccaagattccctttactacagcctggaattccaccacaacggggtatccctcccccatcggtacttgacgcagctcttcatccaccaccccgtggaccttttcctccaggggatctttttagtcagccagaaagaccttttctggctcctggaagaccaaatatagacagtgttcctaacccagataaaagaataccacttgggaatgacaatatccagcaggaaggggatagagattaccgctttcctcctatagaaaccagggagggcattaatagacctcctccagtggatgttagggatgtggttggacgacctatagatcccagagaaggccctggtaggcctccgttagatggtagggatcattttggaagacctccagtggacatgagagagactcttgtgaggccaggtctagaccaccttggccgaagagaccactttggctttcccccagaaaagccttgggggcctagagatttcgatgagagagagcaccgagttctgcctgtctttggtggtccaaagggcttacatgaagaaagaggcagatttcgggctggaaattatcgatttgatcctagaagtggtccttggaacagaggatttggacaagaagttcacagagattttgatgaccgcagaagaccctgggagaggcagagggatagggatgacagagattttgatttctgcagagaaattaatgggaatcgtcttggacgagatagaattcaaaacacttgggttccccctcctcatgctcgggtttttgattatttcgaaggggccacttctcaacggaaaggtgagaatgtgcctcaagttaatggtggaaatacagagagacatgctccgccaccgcctttgccagtgcagaaggaccctgaactctatgagaagctggcgtcttcaggagacgcagacaaggaggagagcggcacagctgctggtgtagagagtgaagcggtggtagaaagcacagagactgaggggacataacatcgctcagtaggtaaaagaaaccttttgtacagttgtcatctctgtaagaggttaatggctgactgcaccacagttgttcacgtttatctaccagaactaagttaatctgatgtacgtgttcacctttctcttaaaataattgtacaactgacttgtatagacattgttcttaatatgaacatggtaggtaaacatttttttatttttctgataaagtataaatgttgccccagattcttttaacgtcaaggagatgctaacagcttgtcgagacttcctatggaagagaaggttttagacacagtcattgggatgggtatggcaatgacatatttcagaacagcaaggtgtggcacatctccatatctctaggctgctgcagggttttaaggtgacagacaaagctgtgatattttatgcaaggactggctctagattcttgaggagcataatacagagattttaaaaagtgattttgtaaaaatctccactatggtctctgttactccaaagtaagtgtgtgtgatttgttcctcatactgcagtaagtaaaaaagaaaagaagcaaacaacataaacattcaaatacgttttaatgttgggtgaattttgtttttagatgccaataaaacttatttgtttgaaaaaaaaaaaaaaaaaaa

SEQ ID NO: 4270 - DNA, 3531 bp, Rattus norvegicus
  Genbank Accession No. NM_139098
cacgctctgatggcggtcactgctggagctttggccatttcgtagggccggtcctcgctcggtactgtgaggacttggtgcctccctcctttgtcctcttcaccggtctgcgcatcgtccccaagggcgcaggccttccgctggctggcagcatgggcagggagtctcgccattaccgaaaacggtcagcatctcgaggtcgctctggaagtcggtctaggagtcgctcaccctctgacaaaagaagcaaacgtggagatgacaggcgttccaggagtagagacagagacagaaggagagagaggtctcggagcagggacaaaaggagatctcggtcacgggacaggaaacgcctgagacgttccagaagtagagagcgtgacagaagccgagagcgaagaagatctcgaagccgggatagaaggcgctcaaggagtcggagccggggcaggcggtcccggtcttccagtcctggcagcaaaagcaagaaggctgagaacaggtctaggtccaaagagaaagcagaaggtggggacagctccaaggagaagaagaaagacaaggacgacaaggaggacgagaaagagaaggatgctgggaattttgaccagaataagctggaagaagaaatgagaaaacgaaaagaaagggttgaaaaatggcgagaagagcagcgtaaaaaggcgatggagaacataggggagctgaagaaggagatcgaggagatgaagcaggggaagaagtggagcctggaagatgacgacgatgatgaagatgaccctgccgaggctgagaaggaagggaatgaaatggaggacgaggagctggacccattagatgcctacatggaggaagtgaaagaagaggtaaaaaagtttaacatgaggagcgtgaaaggcggcgcaggaaatgagaagaagtccggaccgactgtcacgaaagtggttactgtggtaacaaccaagaaagcagtagtagatgccgacaagaagaagggagagctgatggagaatgaccaggacgccatggagtactcctcggaggaggaagaggttgaccttcagacggccctcacaggctaccagacaaaacagagaaagcttctagagccagtggatcatgggaaaattgagtatgagccattcagaaaaaacttttacgttgaagttccagaattagcgaaaatgtctcaagaagaggtgaatgtgtttcggttggaaatggagggcattacagttaaaggaaaaggttgccccaagccaattaaatcatgggtccagtgtggaatttccatgaagatactgaattccctcaaaaagcatggctatgaaaagcccacaccaatccaaactcaagcaattcctgctataatgtctggacgagatttgattggcattgccaagacaggaagtggaaaaaccattgcttttcttttgcccatgtttagacacatcatggatcagaggtcattggaagaaggagagggaccaatcgctgtcatcatgactccaactcgagaactggctttacaaatcactaaagaatgtaagaagttttcgaagaccttgggactgagagtggtctgtgtgtatggagggacaggaatcagcgagcagattgctgagctgaagagaggcgctgagatcattgtttgcacacctggccggatgatcgacatgctggcagctaacagtggtcgggtcacaaatcttcgaagagtgacatatgttgttttagatgaagcagacagaatgtttgacatgggttttgaaccacaggtcatgcgcattgtggacaatgtccgtcctgaccgacagacagttatgttctcagctactttcccaagagctatggaagcgttggcccgcaggatcttgagcaagcccattgaagttcaggttggaggccggagtgtggtttgctcagatgtggaacaacaagtgattgtgattgaagaagagaagaaattcttgaaattgctggagcttttaggccattatcaggagtcaggatctgtcattatatttgtggataagcaggaacacgctgatggtcttctgaaggacttgatgagagcttcctacccttgcatgtctcttcacggaggtattgatcagtatgacagggacagtatcataaatgactttaagaatggaacctgcaaacttctcgtagccacgtctgttgccgcccgtggtctagatgtgaaacatctcattcttgtagtaaattacagctgccccaatcattacgaagattacgtgcacagggctgggcggactggaagagcaggcaacaagggttatgcctacaccttcatcacagaagaccaagctcgatatgctggggacatcattaaagctcttgaactgtcggggacggcggtgcctcctgacctagagaaactatggagtgacttcaaagatcagcagaaagctgaaggaaaaataattaaaaagagcagcggcttctctggcaaggggttcaagtttgatgagacagagcaggctttagccaatgagaggaaaaagctacaaaaagctgcccttggcctgcaggattctgatgacgaggacgccgcagttgatattgacgagcagattgaaagcatgtttaattccaagaagagagtgaaagacatggctgctcccggcacatccagtgcgcctgctccgactgcgggcaatgctgagaagctagagattgccaagaggttggcgcttagaatcaacgctcagaagaacctgggcatcgagtctcaggtagatgtgatgcagcaggccacaaatgccatcctcagaggtggccctcttctggctcccaccgtgtctgcaaaaaccatcgcagagcagcttgccgagaagatcaatgccaagctcaattacgtgcctttggagaaacaggaagaagagagacaggagggtgggcagagcgaatctttcaagagatacgaggaagaattagaaattaatgacttcccacagacggcgaggtggaaagttacctctaaggaagccttgcagaggatcagtgagtactcggaagccgccatcacaatcagagggacctacttcccgcctggcaaagagcccaaggaaggagagcggaagatctacttggcgattgaaagtgccaacgagctggctgtgcagaaagcaaaggcagagatcaccaggctcataaaagaggagctgatccgactgcaaaattcataccaacccaccaacaaaggacgatacaaagtattataaacaccggagccactttgtacccgtgctatctgtgacgtttacagtgtattgtaaagtaagacttttaaaattctgtcttgcttattttttaagtacaagaaaccagtgtttgttcaagaggtcatctgtaagtactaccctatacccatccaaactccatttaaatcagagctgttttcagagtgtgatgttcttcgatgtaaaccttagataccaacactttaaatatctggagacattgggattttgtactgaatgcagtaataaagtgtgtcaggca

SEQ ID NO: 4271 - DNA, 404 bp, Rattus norvegicus
  Genbank Accession No. NM_139099
ggaattccggggctcaggctactctgaagcgacccagcgttctgcctgacacgccccgctcgagacaccatggtggcgtactggcgacaggctggactcagctacatccggttctcccagatctgtgcaaaagcagtgagggatgccctgaagactgagttcaaagcgaacgctgagaagacttcgggcaccagcataaaaacagtgaaaataaagaaggagtagccgagcctgactgaagcctgacgtgcggagtcttccaggtgaagcatgtgggcacctgttccggcagatggaggtcagccgtacctcctggagacagacacccatcttgttgatgaattgactatgccaataaattaacacggttcactctcggcaaaaaaaaaaaaaaaaaaaaaaaa

SEQ ID NO: 4272 - DNA, 1263 bp, Rattus norvegicus
  Genbank Accession No. NM_139100
aattccggccatcttaggaggatgttctcgtccgtagcgcacctggcgcgggcgaaccccttcaacgcgccacatctgcagctggtgcacgatgtgtcgggtccccgcagccccccaggtccgccccggcgttcccgccacctggctgccgccgccgtggaagggtacagttgtgaatttggctccatgaagtattatgcactgtgtggctttggtggggtcttaagttgtgggctgacacacactgctgttgttcctctggatttagtaaaatgccgcatgcaggtggaccctcagaagtacaagggcatatttaatggtttctccattacattgaaagaagatggcgttcgtggtttggctaaaggatgggccccaactttgattggctattccatgcaagggctctgcaaattcggcttttatgaagtcttcaaagccttatatagcaacatacttggtgaggagaacacctatctgtggcgtacatcactgtatctagctgcttctgccagtgctgagttctttgctgacattgccctggctcctatggaagctgctaaagttcgaattcaaacccagcctggctatgccaacacactgagggaagctgtccccaaaatgtataaagaagaaggcttaaatgcgttctacaagggtgttgctcctgtgtggatgagacagatcccatacaccatgatgaagttcgcctgctttgaacggactgttgaagctttgtacaaatttgtggttcctaagccccgaagtgaatgtacaaaggcagagcagctggttgtgacatttgtggcaggttacatagccggagtcttttgtgcgattgtctctcaccctgctgactctgtggtctctgtgctgaataaagagaaaggcagcactgcctctcaggtcctgcagaggcttggctttagaggtgtatggaaggggctcttcgcccgaatcatcatgattggcactctgacggcactgcagtggttcatctatgactctgtgaaggtctacttcaggctccctcgccctcctccacctgagatgccagagtctctgaagaagaagcttgggttaactgagtagatatacatcaaagtaacatggactgaatctgcttgttgatcagtgttgaaagtgcaaaggaacttttatatatttgacaatgtaggaaatgtctgttcctgatacaattactgtagtacccttgcttaaagcaagagtttcaaacttactgctaaataaacccatccggaa

SEQ ID NO: 4273 - DNA, 7628 bp, Rattus norvegicus
  Genbank Accession No. NM_139101
cccgctgtacttcaccaggcagtactaggccatagatcccgtgttccgggctcggcgctccgggcttcccagggctgggcccgggacgcggcctcccgccatggcgcagctggagggttattacttctcggccgccttgagctgcaccttcctggtgtcctgcctgctcttctccgccttcagccgcgctctgcgtgagccttacatggacgagatcttccacctgccgcaggcgcagcgctactgcgagggccgcttctcactgtcacagtgggatcctatgattactacattacctggcctgtacctggtgtcggtcggagtggtcaaacctgccagctggatccttggctggtctgagcatgtcgtctgctccatcggaatgctcagatttgtcaatcttctcttcagtgttggcaacttctatttgctgtatttgctcttcaggaagatacagcccagaaacaaggcttcttcaagtatccagagaatcttgtcaacattaaccctagcagtatttccaaccctctatttttttaactttctttactatacagaagccggctctgtattctttactctttttgcttatttgatgtgtctttacggcaaccataggacttcggccttgcttgggttttgtggcttcatgtttcgtcagaccaatatcatctgggctgccttctgtgcaggacacatcattgcacagaagtgcagtgaagcctggaagactgaactacagaagaagaaggaagagaggcttcccccggctaaaggaccgctctcggaactcagaagagttcttcagtttctgctgatgtactccatgtcccttaagaacctgagtatgcttttccttttgacctggccctacatgcttctgctgttggcatttttcgtttttgtggtggttaatggtgggattgtcgtgggtgatcggagtagtcatgaggcctgcctccattttcctcagttgttctacttcttctcctttactgcctttttttcctttcctcacctactttctccgaccaaagtcaagacttttcttagcttagtttggaaacgtagagttcagttctctgtgattactttagtctcggtatttttggtttggaaattcacttacgtccataagtatttactggcagacaataggcattacacgttttatgtgtggaaaagagtatttcagagacatgaaattgtcaagtatttattagttccagcctacatgtttgctggttgggctgtagctgactctttaaaatcaaagtcaattttctggaatttaatgttttttgtatgcttggttgcttctacggttcctcagaaactactagaattccgttacttcattttaccatacattatttataggctcaacatgcctctgccacccatatctagacttgtttgtgaactgggttgctatgcagttgtcaattttctaactttttacatctttctgaacaagacttttcagtggtcggatagtcatgacatccaaaggtttatgtggtagtggcagggctattttgaactctaagagcctatttctacaacagatgactgggtaaaggagtgtggatttcttttaagtaaattcagggagacgaaaagaattacatttgaggctagcctaaaagcttagataatgctaataaatttgcttgcagttgtcttgagaatcttttcagaagtttggggattttccgtgtatgtaggggactgggtgagctccgtagcaccagaacctgtcaaccaacttcctttgtaaagaacagtgaagaatgtgaaaactgtttacaaataaatgacctagtggtatttctgagcaaaattgccagatattgcagtaaatatagctctggtcttagtaacttatgaacgagattctgggatgtctatctaggaattgggtattttaactaagaatatagaagtgatgaagccatttgaactaactccttatttgaaggttttgcaggccgaaggtaagctgtgctgattatgacaccttttatagataatctttctgaaatactgctctgttagttgtccagggctcctgcacaaaactgaccataaaccttgtggcttcagagttttttctcacatacgaataagcagcacctaaactcgagtgctggcagagctcctaaactcgagtgctggcagagctcgctccttcaggagacaagagttcattgttcctgttcagctcactccttagaggggccttacttttagacaggtccctccagtctgtctgtgtctgcacaggactgtctccaccggcttcttgtgcagttaatgccattggctttagggatcctctgattcagggtaacggtacctggagaccctggattatatctatcacatttttaaagtaagttccctttcagaggtcccacatcattttggtgtgtgtgtgtgtgtgtgtgtgtgtgtgtgtgtgtgtgtgtgtgtgtgtgtgtaagtaagatgaccttgatgagagcttttaagtaaaagttagtttttaaaagagaggccaaaaaacaacaacaacaaaacccagatggccaaggtcatgtaatttacatttgtccctattatccaaacaaaccagaactcagaaggtgagaggtcattggtttagtttcattttataatttaggaagcactactaggctctggggtttgctttgtctgggttccggttctgtgctgctgtttaaagtttgtttattgattgtcaccattgttacagacactgttgcttagtcctgtgctgagagtgtaaacacggaagtgtgacttgggcttacttagcccacttcctgagctttacacacacacacacacacacacacacacacacacacactcactccccaaaggaacagaaccttttattttattggataatgttttctttgagttttaaatatgtagtaaactttatacaactttaaaaactacttggataaaagttacaagcatagccctgggtggtcagcccgcacagaccactctgatgcttcggaggtttgctcaagtgtaacagtgactggtgtgttagcacatcagaaagcttcatgacactttattatgatagaagctaagtccaggaagcaaacacttgcaattgaataaagcaagtgctgtctgatgcttagtccctggcttttgtgtctgggaacacagagggatggagtgcttcatcccagtagtctgctgtaaggagggaagcactttgtcccatgtaatggaaggaggctgctttcagatatgttgagtcccttcagaattaggagacatcgtaggggtctacagagagagagagagagagagagagagaaagagagagagagagagagagagagagagagagaaaataagtactggtattctacaccacttcccattatgtattggaagtaggacttggcatttcagactgcagtgccatggactaaaaggtgctatttagttgttactgtgatcttaaaaatggatgcatgttgatacatttgaggtaggggtttggttaatgttgcttgggcagttgacaagttaatggtcatttgctgataaatttctcagtcttttaactcagtatgtgagagaaaaaggcttcacccggcggttcacttttggttgttcaaattaacagccccatctctgaagtcatttcacttgggaaaaaaatccttgcttttgcaaatgtagattgtatttctactttaatttttaaaaagaattatcaagtagttttcattagacttaattgatttattgatcataagaggctcagtggttaaaagcttgagcccccattgcagggacccccgtgtggttccttgcccctagggcagcctctagggcactgactgcaggcttccagctctgcagcctcctgaactcatctgctgtaaacacactgcccaccgcctacttcagttaaaaactctaaatggtcagtgtagaaaatgtcagctgctgaaggggtgtggagtgcgagttctccatcactcttccagtggacattttagagcctttatgaagaggcccaggcttgcctgagctgctctaggctcagtggtcagttttagcagctctgctttctgtgacaatccacaggcatagactcacttcccagacacattagaacgagtgtgtgcactgtacctgcttatatttacacttccttggacagccttcccacggctgcgtctcaccaaaccttgtggacatagtgtgttgtactttacacatagtacataatcttgtacgaggaatttctgtgctcatggaccatctgtgtttgtcgttgtaaaacacccactgtaaacagtgtgatttacttacagggaatagcttaggatatccgtgatgtatttctggtgtgaacttacctgacttggacattgtgctcatctcctttgtctggagaggagagaagggagtcccagctttcatttataactcctagagagtagacatatattttaggtcaagttcaaactgtattcaggtaaaatcatatcttagagcagttagaaagcctttaaatgttaagacaagtgtaattttaatgtatacaatattttgcatagatgaacttaagatgtagaaaagaatgcccttgattttggttccacataaaaaagacagattgttgaaagacaggtgcttgttcctgatctcagatgagaatgttatgtttgaactcttgttagtacctggggtgagtcctaccgcatttcaacaggattcatgctgtagtacatatctgtatgctcataaacatgctgtttgatgtatatcgagtaaatttgtattgaatggagttttcaatatagaaggaagcagatattctagaaaagtatcatataaccaacttaatcttaggaagcaaatgtgttttatactaagccatcctgacccatcctctgcctgttttctgaatgttattttctatagtaatgaatttagtcatgcccgtttagtatgcgccgtgtgcaataggcttgattctaacaatgccatttaaatatgaagtcattcagtaattacagtaagtttgatgacttgtcttttacatttcaatcagttagaaacatcttctgtttggttttagctctctgatttacttttctttgggtgcattttaggtatttgaagtcaatggcaaaatgttgctgagaaatataaacaacttagttaatgatgacataattttaatatatcgaaatgattccagcactaaattccataatgtttggaagttatttctaaagtaaatttggtgataataggtatctaataatctctttttattatttaaaatgagatattgattagtggcattctccataccttagacactgttaaagcaaaagtaggtagggtatatttttctttcaaaaaagtaaatatatggaatttgcattcagaaatttgatcagttcaatttatttgagccctgtactttcactgtcttgctcaagatgaataagaatgaaaagaattacagtagttgtctttctcaatagtgttttgctggttcacacacacacacgcactcacactcacactcacacacatcataaagctgaccttttgctattttgtttcgctatcaaagctgtactggtctgacctctcatgttattgtgtgagttacaggtttttaaaatccttaggagccttttagaggaacatgtataaaatgataaacgcttaggttttattacaagatgagttgttgaacaaattgttgatgtttaattggaaaaacatagctcccataacaacaagttcttacggttatttgaaagcataatacattgctttaaatgtagatcagtggtcaacaaataggttttaactcacaaaaacaccctttcttaattatgttgtctctttaggggcatagagctcccctaaataagttttgtatttactgaaaacatttcactgggaaagcgtcagtggcttgagagagtagatatgggatagtgtcttttcaagggtctcaaaacctgccattttaaacgtgagtttattgtagttcatgttctttatattcttcggtaagtcaggttcaagaatctcttgaagtattctgcctttcatatattttgtttctgaaataaagtggatgtttagctttcgttaagctggtttttaaattgtgtcatacacccagccacaggtggtgtaaagtctcagcgcaccagtaatgcagtgtttacccacatacgtttgtgttcctttgtcaggagagaagtgtatttgggtttcccctgtagtgaggaataggaaagtactgtgtaatcaaatttgtactgaaatgtttactaggtgatgacagtgggctacattttaacgtattcttgtaatttaactttttctactagtctggattaaactttttatagttttgtattgttttgaaccacaaagatttagaattctccaccttcattaatgattatttgttgttcaggaagggtctcataatccaggctagcctggaatttacaatgtagccaagaaagaccttgaactcctgattcttttgcctctacctctggactgctgggttcccggcatgccgcaccatgcccagtgtatgcagtgctggggagcaaacacagaacttagggcagccggcaagcagtctgccagctgggctgtttcctccagccctgctgcttctactgtggccgaaaatgttccctgggttccatgaagtggaaggtaaatgtgaaaccaaaagtcatttgttccatgattaaattgtgtctcagatgacggaacctaatgcacccggccatgaaactgtttacctcacagactgggggatgtttctgatagtgataataggtttggaaacaacctgaactgtctacttctgtctcgctggttctcaggcctcttgtgttaactgtaccacatacacggagagactgaggagagggtgggtttttgtctcatattagaataagcagaatgagtatttgtctaatgttacaaagtagctgtgtgagctgcctttatgagtgggcagcctgacgagaatcgggctcttagctgcagctgagatggagtagtaggaaggacactgagtctaccttcctttttgtaacattttggaaaacaaattccatgggaaatagaactccactacttttctagatcagacagttgaggcgcatacagactgtctcttccagagcaggcagtctctcccattgtgtcatcacggcctcagcttgttgtgtgaacacaaaatctacagcacgggctgaagttgtcagcccgattaacaaggaagtaaagatctttgatatccaatagagatgtagttgcctaagaattaatttctcaaaagaactttggaaataaatggttgttttaaactgatctgtgatttttaaataatcttttctgaaagaatttgatgtttattttaaatacgtgaatatatgttttaaccgttttttaaggttttacattttgttacattcaaaacttaagatgtttgactctaaaattgtgattcatgtcatttaaactcttgaataaacctatttataagaataaaagcgttttaaatagttaaaaaaaaa

SEQ ID NO: 4274 - DNA, 2574 bp, Rattus norvegicus
  Genbank Accession No. NM_139102
atgctccgcctgggcgcgctccggctgcggggcctcgcgctccggagctcccaggggcgcccaagctccgccggcctccgggaaggacaggaaagcccaccctcacccccagaatggaaggacagagcagagactgtgatcattggaggtggctgcgtgggcgtgagtctggcttaccatctggccaaggcagggatgagagacgtggtcctgttggagaagtcggaactcacggctggctctacctggcacgcagcaggtttaacaacttactttcaccccgggataaacttgaagaagatacattatgacagcatcaaactttacgagaggctggaagaagaaactggacaggtggtggggttccatcaaccgggtagtatcaggcttgcgacaactcctgaaagggtggacgaatttaaataccaaatgacgcgaaccaactggcatgccaccgagcagtatattattgagcccgaaaaaatccacgagctgttccctttactcaacatggacaagattttagccggactgtataacccgggagatggccacatcgatccgtattctctgacgatggccctggctactggagctaggaaatatggggtccttctaaagtatcctgcaccagtgacatctctgaagcccaggccagatgggacatgggacgtggagactccgcaaggatctgtgagagcaaatcgaattgtgaatgctgcgggattttgggctcgtgaagtgggtaaaatgattggactagaccatcccctcatccctgtgcaacatcaatatgtcgtcacatcaacaatcccagaagtgaaggctttgaaacgagaactcccagtccttcgtgacttggaaggatcctactacctccgacaggaaagggacgggcttttgtttggtccctatgaaagtcaggagaagatgaaacttcaagcctcctgggtcgctcatggagtccctccaggctttgggaaggaactttttgagtctgacttagaccgaatcacagagcacgtggaagctgccatggaaatggttcctgttctgaaaaaggcggacatcatcaacatcgtaaacggtcctatcacctactctcctgacattctgcctatggtggggccccatcagggggtcaggaactactgggtggccattggctttggatatggcataatccatgccggtggggtcgggaagtacctcagcgactggatcctgcacggagaacctccctttgacctgatagaactggatcccaaccgctacggcaagtggacgacgacgcagtacaccgaggccaaagcccgagaatcatacgggttcaacaacattgttggttatcctaaagaggaacggtttgctgggaggccaacccagagagtcagtgggctctacaaaatcctcgagtccaagtgttccatgggtttccatgcaggctgggaacagccacactggttctacaagcccggccaggacactcagtataggccaagtttccgccgcacaaactggtttaggccggtgggctctgagtacaaacaggttatgcaaagagttggtgtgattgacctgtctccgtttggcaagttcaacatcaaaggccaagattccacccagcttctggatcatctctgtgcaaatgtcattcccaaggtgggttttacaaacataagtcacatgttgacgcccagaggtcgagtgtacgctgagctgactgtttcccaccaatctcctggggagttcctgttgattactggctctgggtcggaacttcacgatcttagatggattgaagaagcagccgtcagaggtggctatgatgtggaaattcgaaacataaccgatgagcttggggtcctgggagtagcagggccatatgcaaggagagtccttcagaagctgacctcagaagatctcagtgatgatgtcttcaagtttcttcaaaccaagtctttaaagatctctgacattcctgtcactgctatcaggatctcctatactggtgagctgggatgggagctgtaccacagacgagaagattctgcagccctttatgagcggatcatgaatgcgggccaggaggagggcatcgacaattttggaacatatgccctgaatgccttaagactggagaaggctttccgggcctgggggtcagagatgaactgtgacacaaaccctttggaagctgggctggactatttcatcaagctgaacaagccagccgacttcacagggaagcaagcgctgaagcagattaaagccaaggggctgaagcggagactggtgtgcctcaccttggcaacagacgatgtggatccagagggaaatgaaagcgtttggtacaagggcaaggtgattggcaacacaacatctggaagctacagttacagcatccagaagagcctggcttttgcttatgtcccagttgagctcagtgaagtgggacaacaagtggaggttgaactactgggtaaaaattacccagcaaccattatacaggaaccattggtactcacagaacctaccagaaccaggcttcagaaagatggtaggaaatcttga

SEQ ID NO: 4275 - DNA, 1664 bp, Rattus norvegicus
  Genbank Accession No. NM_139105
agctagggccatgttttggggctcccgtctgcctttgagagtctttttcgggtcccttcctggccttcttaatacgtggcagagcgtctggaccagaagactacactgtgcaaccaccatgagtcttgacatccagtgtgagcagctgagtgatgcccggtggacagagctccttcccctgatccaacaataccaagtggtcaggctggatgactgtggcctcactgaagtgcggtgcaaagacatcaggtcagcgatccaggccaaccctgccctgacagagctcagcctacgcaccaatgaactgggtgatgctggtgtgggtctggtgctccagggcctgcagaatcccacttgtaagatccagaagctgagccttcagaactgcagcttgacggaagctggctgtggggtcctgcctgatgtgctgcgctctttgtctaccctgcgtgaactacatctcaatgacaaccctctgggggatgaaggcctgaagctgctctgtgaaggactccgggacccccagtgccgtcttgagaagcttcagttggaatactgtaacctcacagctaccagctgcgagcccctggcctcagtgctcagggtgaaacctgactttaaagagctagtattgagcaacaatgacttccatgaggctggtatccacactctgtgccagggcctgaaggattctgcctgtcaactggagtcactcaaactggagaactgtggtatcacatcagccaactgcaaggatctgtgtgatgttgtggcctccaaagcctcactgcaagaactggacttgggcagcaacaagctgggcaacacaggcattgcagcactgtgctcaggactgctgcttcccagctgcaggctgaggactctgtggctctgggactgtgatgtcactgcagaaggctgcaaggacctgtgccgtgtcctcagagccaagcagagcctgaaggaactcagcctagctggcaatgagctgaaggatgagggtgcccaactgctgtgtgagagcctgttagagcctggctgtcagctggagtcactgtgggtaaagacctgtagcctcacagctgcctcttgtccccacttctgctcggtgttgaccaaaaacagttctctgtttgagttgcaaatgagcagcaacccgctgggagactcgggagtcgtggagctttgcaaggccctgggctatccggacacagtgctgcgtgtgctttggctgggagactgtgatgtgacagacagtggctgcagcagccttgccactgtcctgctggccaaccgcagcttgagggaactggacctcagtaacaactgcatgggggacaacggtgtcctacaactgctggagagcctcaaacagcccagctgcatccttcagcagcttgtcctgtatgacatttactggacggatgaggtggaagaccagcttcgggccctggaggaggaaaggccatccctgaggatcatttcctgagatgtacacctctggacacaagatattaatccagccccagaggcagcccaccagatctctggctttggttgtcctagggttggactggcgataagcattgggatcttacttcagtagaaaactttaagacactttataactattaaaatactttgttggcaaaaaaaaaaaaaaa

SEQ ID NO: 4276 - DNA, 811 bp, Rattus norvegicus
  Genbank Accession No. NM_139106
ggaattccgctgctgtcgctaagctaaagtcactgacgtttccgccaccatgctgcccgccgcattgcttcgtcacccaggtctgcgccgtctggtgctccaggcgcgtacgtacgcccaggccgccgcctcacctgcccccgccgctgggcctggacagatgtccttcaccttcgcctccccgacgcaggtgttctttgatggtgccaatgtccggcaagtggatgtgcctacgctgactggagcctttggcatcctggcatcccatgtccccacactacaggtcctacggcctgggctggtaatggttcatgcggaagatggcaccacaactaagtattttgtgagcagcggctccgtcactgtgaatgcggactcctctgtgcaattactagctgaagaagtcgtgacactggacatgctggacctcggggcagcccgggcaaacctggagaaggcgcagtcagagctgtcaggggcagcagatgaggcagcacgggctgagatccaaatccggatcgaggccaatgaagccctggtgaaggccctggagtaggcgtactttgtctgtcacccacagggtaacagaggcaggtcctggggggctgaagtcgccaccagggggcagcagtgctccggttactggcttaaagcttccctggtgctgcctgccaggtcatggagggcttccccaggcttccagagtctgggatccccaggatgcctctggagagctggccttgattgcccctcaaagccacccggacagtcagctggcccagcctatctgcattaaataccacggaattcc

SEQ ID NO: 4277 - DNA, 1775 bp, Rattus norvegicus
  Genbank Accession No. NM_139113
ggttggcctggaaccggcccgaccagttcctgcctggcgcgcggaccggccgcaggaagttgccgcaaaactttttttgggggggtgcgaccggagccccccgagcgcgcgggctgcatgcgcccgggatagccgggttcccctcgggtcgccaggcgtgcccagagggacggactcgtccggggcgccccggcccgctgtccccggggctatggccatggtgaccggtggctggggcggccccggaggcgacacgaacggcgtggacaaggcaggtgggagctacccacgcgcgaccgaggacgactcggcctcgcctcccggggcgactagcgacgcggagccgggtgacgaggagcgtccggggctgcaggtggactgcgtggtgtgcggggacaagtccagcggcaagcactacggcgtgttcacctgcgagggctgcaagagtttcttcaagcgcacgatccgccgcaatctcagctacacctgccggtccaaccgtgactgtcagattgatcagcatcaccggaaccagtgtcagtactgtcgcctcaagaagtgcttccgggtgggcatgcgcaaggaggcggtgcagccgggcccgatcccgcacgctctcccgggtcccgcggcctgcagccctccgggcgcggcgggagtcgagccgttcgcggggccgccggtgtccgagctgatcgcgcagctgctgcgcgctgagccctaccccgcggctgggcgctttggtggcggcggcgccgtgctgggcatcgacaacgtgtgcgagctggcggcgcgcctactgttcagcacggtcgagtgggcccgccacgcgcccttcttcccggagctgccggccgccgaccaggtgggcctgctgcggctcagctggagcgagctgttcgtgctgaacgcggcgcaggcgccggtaccgctgcacacggcaccgctgctggctgccgcggggctgcacgccggccccatggctgcggagcgcgcggtggccttcatggaccaggtgcgtgccttccaggagcaggtggacaagctgggccgcctgcaggtggatgctgccgagtacggctgcctcaaggccatcgcgctcttcacgcctgatgcctgtggcctttctgacccagcccatgttgagagcctgcaggagaaggcacaggtggccctcaccgagtatgtccgtgcccagtacccatcacagccccagcgctttggacgcctgctgctgcggctgccggccctgcgtgctgtgcctgcatccctcatctcccagcttttcttcatgcgcctggtgggcaagacacccatcgagacgctcatccgggacatgcttctgtcagggagcacctttaactggccctatggctcgggctagtgatggtcctttcctaggacacatggaagctggggccttgtagggaccatggggaccagggccccagcttctcttctgagactgacttctttttttaaagactgtgaaatgtttggtttggtttgttttttaaataatcatgaaaccaaaaagattcggatctcccaggctccagctttgtcctggcagccttcggcagggtggggctgagggtctggagccagcatgctagtgcctctggtgtcctgggtatctggaagggccactgcagctgggcaggggtgctatgggccaggagggtcccctggacacatggcccatggagggaaccatgaaatcatggccaacaataaagatattcccatccttaaaaaaaaaaaaaaaaaaaaaa

SEQ ID NO: 4278 - DNA, 691 bp, Rattus norvegicus
  Genbank Accession No. NM_139114
catcaggtgagccaagatgggtgcatacaaatacatccaggagctgtggaggaagaagcagtccgacgtgatgcgcttccttctaagggtccgctgctggcagtaccgccagctctctgcgctgcacagggctccccgccccacccggcctgataaggctcgaaggctgggatacaaggctaagcaaggttatgtcatttacaggatccgtgtccgccgcggtggtcgcaagcgcccagttcctaagggtgcaacctacggcaagcctgtccaccacggtgttaaccagctgaagtttgcccgaagccttcagtctgttgctgaggagagagctggccgccattgtggagctttgagagtcctgaattcctactgggttggtgaagattccacatataaattttttgaggttatcctcattgatccattccataaagctatcagaagaaatcccgacacccaatggattaccaaaccagtccacaagcacagggagatgcgtgggctgacatctgctggccgcaagagccgtggccttggaaagggccacaagttccaccacaccattggtgggtctcgccgtgcagcctggagaaggcgcaacactcttcagctccaccgttaccgctaattgacgtaatatttgtaaaattcatatccaataaacaacttaggacagtcaaaaaaaaaa

SEQ ID NO: 4279 - DNA, 4689 bp, Rattus norvegicus
  Genbank Accession No. NM_139192
ctgaacacccatccggtgagacaggagggcaggtttccaagcgccgctccgccacacttgatctcagcgctgggaaagtgaagcgagcaaccgacagccacgatgccggcccacatgctccaagagatctccagttcctacacgaccaccactaccatcacagagcctccttccggaaacctgcagaatggacgagagaagatgaagaaggtgcccctctatctggaagaagacatccgtcctgaaatgagagaagatatccacgaccccagctaccaggatgaggaggggcccccgcccaagctggagtacgtctggaggaacatcatcctcatggccctgctgcacgtgggagccctgtacgggatcacactgatcccctcctccaaggtctacaccttgctctgggggatattttactaccttatcagtgccctgggcatcacagccggggctcatcgcttgtggagccacaggacttacaaggctcggctgcccctgaggatcttcctcatcattgccaacaccatggcgttccagaacgatgtatatgaatgggcccgggatcaccgcgcccaccacaagttctctgagacacacgccgaccctcacaactcccgccgtggctttttcttctctcacgtgggttggctgcttgtgcgcaaacacccggctgtcaaagagaagggcggaaagctggacatgtctgacctgaaagctgagaagctggtgatgttccagaggaggtactacaagcctggcctcctgctcatgtgcttcatcctgcccacactggtgccctggtactgctggggcgaaactttcctgcacagcctgttcgtcagcaccttcttgagatacactctggtgctcaacgccacctggctggtgaacagcgctgcccacctctatgggtatcgcccctacgacaagaacattcaatctcgggagaacatcctggtttccctggggtccgtgggcgagggcttccacaactaccatcacgccttcccctacgactactctgccagtgagtaccgctggcacatcaacttcaccacgttcttcatcgactgcatggctgccctgggcctggcttacgaccggaaaaaagtttctaaggccgctgtcttagccaggattaagagaactggagatgggagccacaagagtagctgagttctgggcttctgagttcctgttccaaaagttttctgggcagagatttaatattctgttgattaactactggataatgctatcggaatgttaatgatgcatttaaactattccggtacagtattatgagaaagctttgatcatgttttgaggtaatgcatattttaattagccaggattaaccatgccacaatacatatatatttctaagcatacatgataaatgcatatacaattgtgcacatcagctttaaataataacgatgaatttgaacattctatacagagagtattaaagccaaggaacatgctgttttgatgctagggcaagcatggtgctctttccctgtttgcactgcatccagcttcgttccttcctctgtcatcaccatcttcaggcaaatagctgaccagccactggcctgtgtccaccttccaaagcccaggcaacctttctgctttctgaaatactgatccttcctcctggatatgtctttccttgttctgaactttgagattgctggctcagacttaagatagaacaaaaaccttcctggaagttcccactggtgaacttcactataggttttgccagagggaatagggaaattatcttgattgtagcaagtagatcaccttgagagaagaattagcacgcacggtgtggtttgtaagtaaggatgggagagagctaggaaaaggtggccatatctaatggcctacttaccaagcccccaggcctctctgcataggcatggagtccttccagtccatattctgaacaacagtttttagtgagatttgaataattaaattattttcagagtgaagggaatgggaaatgcatggtctgtgccaggggcggagagtggggaagggttagcttttggtaactgaagatttcttcaatggaaagactcttaatgttaaatgtgcctagaactggtaactaaacagctgacatttggagggaatgtggtgaaaactatgtaaatataagcaaaatccgcacatgaaaatatttcacttagaaaaagtgttgctaaagaaaaaaattcgaaggacaagaggtgttgcctgggttgccagtttctttcgtggcagggcaggaaatagtgaggttgagaggcagcatctgtaagtagatgctaagaggtacatttctaaatgaagcccttggggaacatctgccagggatctagagagtgctggtttcatccattgttttaatttcctccttggattgagtagaaacgtggcttcttgtggtgttgaaccttccccgacttctttgctttgttgccatctagcctgcccagcactgcctagggagcgcctacccaccctgatttcttctgccagctcctacccaccctgatttcttctgccacttctttctttggcattcatttttctttccctggacaggaagctagttacccgagtgtatcaggagcacctggcttgcctttgtccaggcccattcctcctggtatccttgggtgtggaactgctggacagcttcaggaagcagagccaggtgccacttttctgtggctccagatcctccctacctccacccctatgtgcctctgccacagtaatttcagaaaagcttggtacaccctctagcaacatcttggttcagagagtctctctggcttgtgagttaacagctcagccaaatgctgtgttgtctcagtgaggcaaccactgaacgagagggttggttgttgggctgtctctgttggagtcagagtagacaacatgttcacttcttcctgtctgctttgcaaggtgtctgtgactgatcaaggcaggcagggagtggtatagtacttctgaaaggaagaagttccctatttatctgttaaaagaccagaggcatgggcaagtgctcaggacctcacttcgggaagagggtctgcttcctgaaagccagtgtataaggaaaagcttcgactgaacctggtatctaaggtaccatgaactaacactctatcacacagcccagggcaaacagtggtatagaaaagtctagaagaaaacatcacatcagtattttagaaccatccacctttactgtccctgtagcccaatccagagcctggcttttagatctggctgcgtacagtgccaaatgctcagtttacttgtaagatcagagcctttctttctgtgttaattgaacacatgctctgagctgttttgttgaagtagaaaatctagtagaaaatcactgtagatctgatgacctggaaacctctggaaatgccttcgggtggttttatttttccaggtcacagatgcctgatttataagatgaacaatgaaatcagctttctttctcttctgatcttattccctggatttgatgcagcccatgttccaaagcaaagctacatagagacttcaggctgaggtcctggtgtctttaagcaaggacactctttcagatcctctcagaggcgtatttgtaacagtttccacatgaatgtactaatcatgttgggtgccttatcgctttcctaatctacagtgcctgttagcccagcctcactccttcccttaaccctgagatcccgtagatggagcgggtgtagacaagaggctggctggaggatcatcagtacagtgatttgcagaaatcttttatgggcttcattttggaaaaatttgtttttagtaaatgctcaaatttggtgggaagtaatttgaatgtatttgattgtattgtcctcattacaattgttaattagacacgttctacatgacagtagtactcaggggagttttctccctgggctgctaatatctgggtgtaatctctgaaactgtaggtccagtgaggcggcgtgaaaagttagcaaagccaccatctgctggtggtttaagccaaggcctctcttcttcgccactgacttgctatgttatcctttctcttgtaacaaacccatcccagagatgaggcctttaatcatcccaagaacctcctgggctaagtatctgacagtctcacatctcaacatcgtgtattaagtgtccagaacatcagctcaggaggacacgctgaaactctcactctgggcgagtcctgataaaacaggctcctaatactgacctacctcaagggcagttctgaggtgattagagccttttctttttttaagcaagtgtttggagatgcatggcagaggttttcctgcagacttgtaaagagctagatgtgttctaagaccatctttagtctacattgctcttcccagagatctacaactatgacccagccaaagtgcaagcctacctactcactgccataaaaactattcaggaaaccttttcctggcctgaatgagattttgttttttttttttttatgtggggcggttatttgtgacccaagtgtaatttggatgatttttaattaatatcaactcttgaagcctaatatgtactggatttgagattgcatttgttcctaataaaagtggatctagctgtgctgcctgg

SEQ ID NO: 4280 - DNA, 1771 bp, Rattus norvegicus
  Genbank Accession No. NM_139253
gcgtcagggggacgcagctggcaaggttcatccacaagtgcttcgcgactgcgtcagggattatcagggtactggaagcatggcatccctgcagctgctcagaggtcccttcctgtgtgttctgctctgggccttttgtgttcctggtgccagggcccaggagcatggggctggtgtccaccatggcagcgtgggcctggacaagagcacagtgcacgaccaagagcacattatggaacatctggaaggtgtcatcaaccagccagaggcggagatgtccccacaggaactacagctccattatttcaaaatgcatgattacgatggcaacagtttgcttgatggcttagagctctcgacggccatcactcacgtgcacaaggaggaggggagtgagcaggtcccacccatgagcgaggacgagctcatcagcatcatagacggtgtcctgagagacgacgacaagaacaatgacggctacatcgactatgcagagtttgccaagtcgctgcagtaggcggcaggccctttcctgtatgcacacgtgacccttgctaatgtgatggacattctggtaatgagaagcagcttatttctgtctactgctgcagcgctggtaaagcctgtggcagtctgttagactggggtaggaggaagccacaaggaatacggagagaagtggggcagtgtcaatgtgtgtttaaacctgttggacaagagctcgaaccttccgaagggtggtggggtatctcaagctcccgggaacctgactctagatgccactctaacttcttgatgttatttcatgctacctgaaaagtaaagacagtctgctttgccaagtggagacttcagtgacggtggagggagagccaaaagccgcgtatcttcccagttgggtcctgctctgggcagatgtggtcagtatgctgttccccaggcatacagcatcacgtcctaaagccacagcaggagaagaatgtcacccacggagtccaccagacacagagtgaagactccttacccactggcattttggaagcgaagcaccactggcctgaatacttagccttttcagatcttcagtttccttcacaactactgccacaccctgtgctctgtcatttcagcccgagagaaaccttgaattgggtgtgctctccgctcaccacccaccgtttgagctccctgaccttgtgttttatccttgctcccagggctcccttcttggcttatgaactattaacttggtatcgcaggtttaaactgtcagctgctctagcctaagtcagaccagaaaagatcagtcattaagggtggtggctaaccttatccaagttttgaaggaatgtttttaaaattacctctttgagcctgaatatgataattcttttaatttcagggaagaacagaaaaggaagagcagtagtagctgaaagagaaacagccataggtcgtactttgcgttgtgaaacgtcatagacttactgtaaacgaatccagaatgatggtgggatcagaaaaagaaactgaatcaaatttgctttacgatgtatagagacttattttctttattaaagtattcttgtaagaaaacttacgtatttgtaaaacagttttctgtgtcaagtatttgtgcaatcggagctgacttgtaaactattcttgtaagatctcattattttgaaagatttatataatgaactctgactatctgacaataaaatggatgaaaaagtaaaaaaaaaaaaaaaaaaaaaaaaaaaaaaaa

SEQ ID NO: 4281 - DNA, 2141 bp, Rattus norvegicus
  Genbank Accession No. NM_139254
  misc_feature (1)..(2141): n = a or c or g or t
catcctccgcagcccgctgtccgcctgcctcttcgtctctagccgagtgaagtcagcatgagggagatcgtgcacatccaggccggccagtgcggcaaccagataggggccaagttctgggaggtcatcagtgacgagcatggcatagaccccagcggcaactatgtgggggactcggacctgcagctggaacgcatcagtgtctactacaatgaggcctcctctcacaagtatgtgcccagagccattctggtggacctggagcctggaaccatggacagcgttcggtctggggcctttggacacctattcaggcctgacaactttatcttcggtcagagtggtgctggcaacaactgggccaaagggcactatacagagggcgccgagctggtggactcagtcctggatgtcgtgaggaaagaatgtgagaattgtgactgcctgcagggcttccagctcactcactcactgggtgggggcacgggctcaggcatgggcacactgctcatcagcaaagtgcgtgaggagtaccctgaccgcatcatgaacaccttcagcgtggtgccctcacccaaagtgtcagacaccgtggtagagccctacaacgccaccctgtccatccaccagctagtggagaacacggatgagacctactgcatcgacaatgaagccctctacgacatctgcttccgcaccctcaagctggctacacccacctacggggacctcaaccaccttgtgtctgctaccatgagcggagtcaccacctcccttcgattccctggtcagctcaatgcccacctccgcaagctagctgtcaacatggtgcccttcccccgcttgcatttcttcatgccgggctttgccccactaacagcccggggcagccaacagtaccgtgccctgacggtgcctgagctcacccagcagatgttcgacgccaagaacatgatggctgcctgtgacccacgccacggccgctacctgaccgtggccaccgtcttccgtgggcgcatgtccatgaaggaggtggatgagcagatgctggccattcagagtaagaacagtagttacttcgtggagtggatccccaacaacgtcaaggtagcggtgtgtgacatcccgccccgagggctcaagatgtcgtccaccttcatcggcaacagcacggccatccaggagctgttcaagcgcatctccgagcagtttacggccatgttnnnnaaggccttcctccactggtacacgggccaaggcatggatgagatggagttcaccgaggccgagagcaacatgaacgacctggtgtctgagtaccagcagtaccaggacgccactgccgaggaggagggggagatgtatgaagatgacgacgaggagtcggaacgccaggggcccaagtgattcgttgcagctggggtgtggggccaagtggcagccagggccaagacaagcagcatctgtcccccagagccatctagctactgacactgcccccagcttaccttcctaccagctcttcagggcaccctagggctcccgggttaaagtccttcagtatttatggccaccccacgtgagtccacttggctctgtctccccgttttagccacctttgtatttatgttgcttttgtgtctgttttattatggctccaggcctgatgttttatgtttttttttttttattatgctccaggcctgatgttttatgtttttttttttttaaaactgggttgtgtttatatttggaggggggtctacttaataaagtcactgctgtctgtcacataaaaaaaaaaaaatgtgaatccgagtgtttgtgtgtgtgcacgtgtgtccatgcatgtgcgtgtgtacaggtgaatgcgtgtgtacatgtgtcagaggaatgctttcaggagtccgtgctctgtttcggcacacaggttcctggggatcagtttaggttggtttggtggtaagagcttttatctgcccgacccatcatgccagcatttgggctttgttcgtttgtttggtttggctttactttgctgtaagtttttcagagagatcaattgttacctgagccttgcttggaaatgactatgcagcctaagtggccctaacttttagccattctctgccttcaattcc

SEQ ID NO: 4282 - DNA, 1219 bp, Rattus norvegicus
  Genbank Accession No. NM_139255
accactgtcggcaacaagaacccagcgctgtggaagtacgtgcaaccccagggctgtgtgctggagtggattcgaaacattgtggccaaccgcctggccttggatggggccacctgggcagatgtcttcaggcggttcaatagtggcacgtataataaccagtggatgattgtggactacaaggcattcatccccaatgggcccagccctggaagccgggtgctcaccatcctagaacagatcccgggcatggtggtggtggcggacaagactgcagagctctacaagacgacctactgggctagctacaacatcccgtactttgagagtgttttcaaccctagtggtctgcaggccctggtagcccagtacggagattggttctcctacaccaggaaccctcgagccaagatcttccagagggaccaatcactagtggaggacgtagacaccatggtccggctcatgaggtacaatgacttccttcatgaccctccgtcgttgtgtgaggcctgcagcccgaagcccaacgcagagaacgccatctctgcccgctctgatctcaaccctgctaatggctcctacccatttcaggccctgcgtcagcgcgcccatggcggcattgatgtgaaggtgaccagcgttgcgctggctaagtacatgagcatgctggcagccagtggccccacgtgggaccaattgccaccgttccagtggagtaaatcaccattccacaacatgctgcacatgagccagcctgatctttggatgttctcacctgtcaaggtcccatgggactgagaatctgcctccgcccagctgccttcattttgtgtgaccagtggggtcccacacctgctgtccacccattggggttctgtcttcactggactctgattctggtggtttctttcgcaaggacacaacccagtgggctctgagctgcctccgtccctctgccccttcgtggctcttcctccctgtccctgtcaccagcaggctgggacttatgcttggctgtgggcctggtgggaccctgggtggtattctcccagtgctggtccctcagcatgtgtgtgaactgatggggctcctggtgtcactactggctgcgggcctatcgcctcagagcagccctggtgtccccttctctggcagcttccctaagtcaggagcttgaaaacaaaaaccaaagtttctgctcttgaaaaaaaaaaaa

SEQ ID NO: 4283 - DNA, 905 bp, Rattus norvegicus
  Genbank Accession No. NM_139257
ctcttgctctcctccagccacaagtggtctcagaagatgctagaatgtagaggaaacagaagatgaactggcaggttttgcctgtgcgccccttctcagaggatgaacagatcttgtgctatgaagtcctgtgtgctcatccttctcctggccctactgtgtgcagaaagagctcaggggctaaactgctacaattgcacgatgatcccatttggtaatacctgctcatcaactgctacctgcccctaccctgatggagtctgcactattcaggtggcagaagttgttgtgagctctgtaagactgaaagtaaagagcaatctctgccttcccggctgccccaagagtcctcaaacacctgaggtcctcggtaccgttgtccatgtgaatactgactgttgcaatacagatctttgcaacgcagcaggtcccactggaggcagcacgtggaccatggcaggggtgcttctgttcatcctgggctcagtcctcctgcagaccttgctgtgatggaccctccaaggccctgccacccttgtccttttatccttatgtgtaatcactccttcctggagccctctagtgataaattctgagtaataaaaattcagaggggggattgagtgtggaacaccttgttgcaactctatagccactgctggataggttccccactcccctctctagggctttcagatatgtacttcctagaatgccattgtgttttggtttgctgctcttggccctggaggcaggggacagcacggggaagaggcagaaacccaaggcactgtgacaccacctccatccatacataaaaatctggggttctgcagggttcccacacatgcctctgaacatccccctatttgagtccaataaactctctgttctcccacggaatt

SEQ ID NO: 4284 - DNA, 1164 bp, Rattus norvegicus
  Genbank Accession No. NM_139328
cctctataaaaagttgagtttttattagagtatcacattcatacacactgtatggtgatagcagtctttataaccatagtcagagtctaaagggggttggggaaggaaggacctcccatagctctaggcaggggagtcactgttgtccgtgtagcggtgatctccaccaaaggaacaggcttaaccggaggcaggcactcccgcatacaagtaaaatgacagaaaaaccaccagggctggaggttttacatcattttattttccagattgtaattttttttcttttttaaataaaatgccaaggctggcctagaacttattgttgtgtagtctaaaggctggccttgctttttcagtactgttcttggctcccaaactctccaatgctggaattacaggcatgacccagcatgcttggcttcacttatcacttataagtagaagtcttcactgtgctggggtaaaagtttttctttccacatgttcagttaggaatcctaagatgatggctctatagtcagagcttaaaggcctgtggaagaatctcacagataccagcaggccatcaatctgaatccagatcatgggggctgtcatagccaaactccttttgtacatccaaagggtatttgctccacaccagtcgcctgcagcttctctcctcatcactgaggctgttgtattcatcagagcctctggaatcttcatctctatcactgctttcttcatctgggtactcgttgcgccagttattttcactgttttcatcatcttcatcttcataaatatcttctggctgctcatcatcattcaccagctcccattcctggctgtagggctgcacagacaggatgttctcaatccaccctggaggggccatctccatatagtagatgtcatatacatagtcatcactgtgctttggttcctcctggtgttctacttgggatccatcctcagatacagtcagcctctcacggatcaattctacagaattgcagaggatcacatctggatcagatgttttgcggcagtctgtggcagcagcctctgggtcttcttcctcgtggaccaggtccaataactggaagcctccgtccctgacagcttcagacacacactggggctccaaactgttagaggtccccgaggatcggtggctgg

SEQ ID NO: 4285 - DNA, 1795 bp, Rattus norvegicus
  Genbank Accession No. NM_139329
gcgagcggaaggaaggaagcctgtgtgcatctagctggtccaccagtccaggacacaacatctcccagtggccagtttgggcgccctgggacttcctacagctggccatggcagactctgcacaggtgccagcactggtatacctggtcacaggtggctgtggcttcctgggggagcatattgttcgaatgctgctggagtgggagcccaggctccgggagctgcgtgtctttgacctgcacctgagttcttggctggaggagctgaaaacagggcctgtgcaggtgactgccatccagggggatgtgactcaggcccacgaggtggcagcagccatggctggatctcatgtggtcatccatacagctgggctggtagatgtgtttgggaaggccagtccagagaccatccacaaagtcaatgtgcagggcacacagaatgtgattgacgcttgtgtgcagaccgggactcggctcctggtctacacgagtagcatggaagtggtagggcctaatgtcaagggccaccccttctacaggggcaatgaagacaccccatatgaggccatccacaggcatccctacccatgtagcaaggccctcgctgagcagttggtcctcgaggccaatggaaggaagggactgcgctttggaggtcggctgtttcgggccatcccagcttccgtggagcatggtcgggtctacgttggcaatgtggcttggatgcatatactggtggcccgagagctggagcagcgggcagcactcatgggtggccaggtgtatttctgctatgataagtcaccttataaaagctacgaggacttcaacatggagtttctgagtccctgtggacttcggctgataggcacccacccactgctgccctactggctactggtgctgctgactgccctcaacgctctgctgcagtggctgcttcggccgctggtgctgtacacacccctgctgaatccctacactctggctgtggccaacaccacctttactgtcagcaccaacaaggcacagcgccatttcggctacaagcccctcttctcatgggaagagagcagggcccgcaccattcactgggtgcaggccatggagggttccgcctggtgatggcagggccaggaactggagaccactgtggcacactccaggtcctgagcccccaaaagcctggacggagagaaatggctaccttttgaagctgctgactctgctagacacatcaggactgtgctatggaccctgccacgtctgtgcctggttcatatcccagtctccaagttctaggacagagtctgggtgcaggcctatctttggtgccaactcgggcctgccagctagttggcaaaaactgattcctgaatggtctcactaccccttcctgtttctagtttctcaagcagggagggacagagactccagaggtctgttgctggcctgcttactccaggtaccattttcagacctggctcctgccacatctggttctccattttcttttcttttttttttttctttttcttttttttttatttttttcggagctggggaccgaacccagggccttcgcttgctaggcaagcgctctaccactgagctaaatcgttttcttaagtgtatctcttttagacatttttcttttaatttgctttaaagaaaactgaaggaatgaatggttttccatgtcttgccttcttaacaaattcagctatgatattgttagcttcctccctgaggatgccaacctgtatctggccacacctggattaaaatcctttgcc

SEQ ID NO: 4286 - DNA, 1853 bp, Rattus norvegicus
  Genbank Accession No. NM_139333
ttcccagctggggtgctgtttgaaagcagtttccgttagctgcagaaggctgaggcgcgccaccggccacctccccacgtgaagcagttgtgcgagcatccgcacgccgggcagctgtctacccgcgtccgagcctccggaagcggcgggggaccggaagtggcccgcggaggctgcagagctagtccgggaacccgctgtgaggcgactggcagcagcgctacgacggcgccatgtccctgatctgctcgatctccaacgaagtgccagagcacccatgcgtgtcccctgtctctaatcatgtgtatgagcggcgactcattgagaagtacattgcagagaatggcacagatcctatcaacaaccagcctctctcagaggagcagctcatcgacatcaaagttgctcatccaatccggcccaagcctccctctgccaccagcatcccagccattctgaaagccttgcaggatgagtgggatgcagtcatgctgcacagcttcactcttcgccagcagctgcagacaacccgccaggaactgtcccacgctctgtaccagcacgatgctgcctgccgagtcattgcccggctcaccaaggaggtcactgctgctcgagaagccctggctaccctgaaaccacaggctggtcttattgtacctcaggctgtgccaagctcacagcccagtgttgtgggtgcaggagagcccatggatttgggtgagcttgtgggaatgacccctgagattatccagaagcttcaagacaaggccactgtactaaccacggagcgtaagaagagaggaaaaactgtccctgaggagctggtgaagcctgaagagctcagcaagtaccggcaggtggcatcccatgtggggctacacagtgctagcattcctgggattcttgctctggacctgtgtccctcagacaccaacaagattcttactggtggggcagataaaaacgttgttgtctttgataagagtactgagcaaatcctggccactctcaaaggccataccaagaaggtcaccagtgtggtgtttcatccttctcaggaattggtgttttctgcgtcccctgatgctactatcaggatttggtccgtcccgaacacttcttgtgtacaggttgttcgggcccatgagagtgcggtgacaggactcagcctccatgccactggagactatctactgagctcctctgatgatcagtactgggcgttctctgacattcagacagggcgtgtgctcaccaaggtgacagatgagacttccggctgctctcttacctgtgcacagttccaccctgatggcctcatctttggaacaggaaccatggactcccacatcaagatctgggacttgaaggaacgcaccaatgtggcgaacttccctggccactccggccccattaccagcattgccttctctgagaatgggtactacctggccacggcagctgatgactcctcagtcaagctctgggacttacgcaagttgaagaacttcaagacattgcagctggacaacaactttgaggtgaagtcactaatctttgaccagagtggcacctacctggcgcttgggggtacagatgtccagatctacatctgcaaacagtggacagagattcttcactttacagagcatagtggcctgaccactggagtggcctttgggcaccacgccaagttcatcgcttcaaccggcatggacaggagcctcaaattctacagtctgtaggccctatgccttgtcacagttctgggcctcatctcagtagtgggttagagttagagggtgggggtggggggtgggactttaggaggagagggaggtctggttatg

SEQ ID NO: 4287 - DNA, 2075 bp, Rattus norvegicus
  Genbank Accession No. NM_139338
gtcgacgctgggcctcctccccgctggtgccccctcaccacacatgcagatctaggattgggcctgggtcttccacttcttgaaatccatgccgaattcccttgctggcgaccaggtccccaaccctactctggatgcaattggcctggtggactggagtctgagaaatgcagggacctctggttccaccccaggcttagaggagggaggcacagacccctggaccttctctcagctgaagaatactgaccaactcaaagaggttggcacagccagcaagctgcaccaggtggtcagcggcttcctcaaggcatgcggactcctgggaagcctctactttttcatctgctccctggacatcctcagctctgcgttccagctactaggcagcaagatggccggagacatttttaaggacaatgtggtgctgtccaaccctgtggctggcttggtcattggtgtggtggtcaccgtccttgtacagagctccagcacatcttcctctatcgtggtcagcatggtggcctctaagtcgctgactgtccaagcgtctgtccctatcatcatgggcgtcaacgtgggcacttccatcaccagcactctggtctcgatggcacagtcaggggatcgggatgaatttcagagggccttcggcggctcggccgtgcacggcatcttcaactggctcacagtgttggtactgctgccactggagaatgccactgcggcactagagagactgagtgagctggccctgggtgctgctagcctgcagccaggggggcaggcccccgacatcctcaaggcactgactcgacctttcacacacctcatcatccagctggatagcagtgtggttaccagcagcattaccagcaacaccactaacagcagcctgattaagcactggtgtggcttcaggggggagacgccccagggaagcagtgaggaatgcgacctctcgggctcttgcacagagaggaacagctcagcatctccaggagaggacagactgctctgccatcacctgtttgcaggctcagagctcacagacctggctgtgggcttcatcctgctggcaggttcgctgctggtgctctgtgtctgtctggtcctcatcgttaaactgctcaactctgtgctgcggggtcgcattgcacaggctgtgaagaccgttatcaatgcagattttcccttcccctttggctggctcagcggctacttggccatcctcgttggagcaggcttaaccttcttgcttcagagcagtagtgtcttcacggcagccattgtgcctctcatgggggttggggtgatcaacctggaacgggcctaccccctcttcctgggctccaacattggcaccaccaccacagccttactggctgccctggccagccctgcagacacgttactcttcgcagttcaggttgctctcatccacttctttttcaacctggctggcatactgctgtggtacctggtgcctgtcttgagactgccaattccattggccaagcgctttggggacctgactgcacaataccgctgggtagccattgtctacttactactcaccttccttctgctacccctagcagcctttggactttccctggctgggggttcagtgctggctgcagtggggggtcctctggtggggctggtactccttatcatcctggttaatgtcctgcaacgacaccgaccatcttggttgcctcgccgtcttcaatcctgggcctggctgccactttggctccattctctggagccctgggaccgcctggtgactggttgttgccccttcaaggcctacagcaactcccatatgaccagcaaagtggctcactgctatgagaacccacaagtcatagcttctcagcagttgtgagaagtgggtgcccatcaaaacccagttccactagcttcggggcattggaggcaggagaaaccactggccaatcttccctggggctgagtggcagggctccacatggatgttttagtctctgcatcctctccttttcaaataaacgaggttactattaaaaaaaaaaaaaaaaaaagtcgac

SEQ ID NO: 4288 - DNA, 608 bp, Rattus norvegicus
  Genbank Accession No. NM_144741
taagaaggagctgtgggacaggagctcatgcccagaaccgagttgtgccctgctgagctctctgccacgtacttaacaggatgaagaacctttcatttctcctccttttccttttcttccttgtcctggggctgctgggccccagcatgtcactgtgtcccatggatgaagccatcagcaagaagatcaatcaagacttcagctccctactgccagctgcaatgaagaacactgtcctacattgctggtcagtctcctccagagggaggctggcctcctgcccagaaggcacaaccgtcactagctgctcctgtggctctggctgtggctcatgggacgtccgtgaggatacaatgtgtcactgccagtgcggaagcatagactggacagcggcccgctgctgtaccctgcgggttggttcctgaggacggttgattgagaactgagcttgccctccgagtgctgccgagggatgagcttgcccaccatgccctgcagaggagggatggggatggggagagcgcagggggcaggaaacgagatgagggtctggaaatacacaatgggatgatggtggtgataaagatgcacggtaaagtggaaaaaaa

SEQ ID NO: 4289 - DNA, 2034 bp, Rattus norvegicus
  Genbank Accession No. NM_144746
ggcacgaggcggcggcgcggtggcggcagcggcagcgcggtggcggccggggctgagcgctcggagcgcctcggtcggccgcgctcagctgggcgcgtcccgcccgcgccatggcaggagccggaggtggcggctgcccgacgggcggcaacgacttccagtggtgcttctcgcaggtgaagggcgctgtcgacgaggacgtggcggaagccgacatcatctccaccgttgagtttaactactctggagaccttcttgcaacaggagacaaaggtggcagagttgttattttccaacgggaacaagagaataaaggccgcgctcactctaggggagagtacaatgtttacagtacctttcagagtcatgagccagagtttgactatttgaaaagtctagaaattgaagaaaaaattaataaaatcaggtggttaccgcaacagaatgctgctcattttctactctctacaaatgataaaactattaaattatggaaaataagtgaacgagataaaagagcagaaggttataacttgaaagatgaagatggacgacttcgagacccatttagaattacggcactacgggttccaatattgaagcccatggaccttatggtagaagcaagtccacgacgaatttttgcaaatgctcatacatatcacataaattccatttcagtaaatagtgatcatgaaacatatctctctgcagatgatctgagaattaacctatggcatttagaaatcacagatagaagcttcaacattgtggacatcaagcctgctaacatggaggagctgacagaagtcatcactgccgcggagttccacccacaccagtgcaatgtattcgtctacagcagcagcaaggggaccatcaggctgtgtgacatgcgttcttctgccctctgtgataggcatgccaagttttttgaagagccagaagatcccagcagtagatcctttttctcagaaataatctcatctatatctgatgtcaagttcagccacagtggtcgatacatgatgaccagagactatctgtcggtgaaggtatgggacctcaacatggagggcaggcctgtcgagacccaccatgtacatgagtacctacgaagcaagctctgctccttgtatgagaatgactgcatctttgacaagttcgagtgctgctggaatggttcagacagtgccattatgacggggtcctacaacaacttctttagaatgtttgatagaaacactcggagggatgttacactggaagcctcaagagagaacagcaagccccgagccagcctgaagccccggaaagtgtgttcagggggtaagaggaagaaggatgagattagcgtggacagtttggacttcaataagaagatccttcacacagcctggcaccccatggagagcattattgctgtagctgccaccaataacttgtatatattccaggacaaaattaattaaggaactgactggaggaccaagtgttgtcttgcatacatacataagccggtcgttttcctgtccaaaaaaggcattgtcctctccattgagaatagtgacgcacttctacttccctcatagacacaggagaagaaggggtctcagctggagccttgggagagatgagtgctgctgctgaagggaaaacctacttgaagctgaattggtggactctgctcaataaaggccattactcaaatgtatttatttaagtctgagccttcctttccagtttttagaccaaaaaactaacatctgagaggaaaaaaaatctcatcaaatctctccagctcttacctctgtctctgccatccatccctgggccttatcctggacatggtgtggccaccacccacgttcctctctggccctggagcccagtggtgcatcacccaccgctggtgcgtggtgcatggctgtgccgagcaggctcaggcagctcttcctcacccactgcacctgccatcacaccttctgtggagctacttaataaacacagcacactgtgaagtgtttctcgtgc

SEQ ID NO: 4290 - DNA, 2525 bp, Rattus norvegicus
  Genbank Accession No. NM_144750
tcaccctgcgggctcctccgcttcccggtcttgctttccctttggctctgtccccactgaggagtccgctgtcccagccatggcgcgtgctaccggacccgagcagcggctgctggccatctacactggcggcaccatcggcatgcggagtgaaggcggagtgctggtacctgggagaggcctggctgctgtcctgaggacacttcacatgctccacgatgaagagtatgccagagcccacagcctgcccgaggatacgctggtgttgcccccggccagttctgaccagaggatcatctacaaggtgctggagtgccagccactcttcgactccagtgacatgaccatcactgaatgggttcagattgcccaaacgatagagagacactacacacagtaccagggctttgtggtcatccacggcacggacaccatggcctttgctgcgtcagtgctctctttcatgctggaaaacctgcagaaaccggtcatcctcacaggtgcccaggttcctatccacgaactgtggagtgatggccgtgagaacctgctgggggctctgctcatggctggccagtacgtcatccctgaggtctgcctgttcttccagaatcagctctttcggggcaatcggacaaccaaggtggacgctcggagatttgcggccttctgctcccctaacctgccccctctagccactgtgggcgcagacgtaacaatcaaccgtgagctggtacggaaggccagttggaagagccacctggtggtccacagcaacatggagcctgatgtgggcctactgcgcctctaccctgggattcccgcctccctggtccggaccttcctccagcccccactgaagggcgtggtcatggagacctttggctccgggaatgggcccaccaagccggacctaatacaggagctccgggcggcggccgaaagaggcctgatcattgtcaactgtacccattgccttcagggggctgtgacttccgactatgcacctgggatggccatggcaggagccggcataatctcaggcttcgacatgacatcagaagctgccctggccaaactgtcctatgtgctgggccagccagggctgagcctgagtgacaggaagaagctgctggccaaggatcttcgcggggagatgacactgcctacaacagatgacttgctgggagatgacatgctgggctgcagggccacatggcttctcagtatgaatggcagccaggatgccgatgccatgaaggatgttctgctgcccggcctggccctggctgcagctcatgctggtgacctggacactctgcaggcctttgtggagctgggcagagacctcaacctgaaggactacagtggccagacgccactgcatgtggctgcacggagagggcatgcttcagtggtcgccatgctactgcagaagggtgtggatgtggatgcctgtaatgaggacggtcagagcccactgctgctggccgtgaggggcaggcatcagagtgtcatcaggctgctgagggccgctggggctcacctgtctccccaggagctggaggacgtggggacagagctgtgcaggctggcatcaagggcggacagcgaaggcctgcgggcgtggtggcaggctggggctgacctaggacagccggactatgatggacactgtgccctgcaagttgctgaagcagcagggaatgcagatgtggtggctctgctgcagagtcttgaggacagggtcagcgcccagccccagccccattagttcttgggctggtctgatgcctcctcagtgaactctcattggtttacgactggatcctggcaccagagccagttctggagacggctagaggaagtgggcataagagatgggtcattcgtccagagcccttcttggggaccccgagagtaaacacggtcttcgggagatagggctggtggggcttcgtgtagaagcccagctcagaccttcaccctacccagtctggagctgattgactggaaggacctaggcctgctcccagctgacatccatccccactgctctggagttttgaggcttggcggactatcctcaactcctgggactgcctggattccatacacaaggcttctggggtggagtacggggaggcctgccctggatgcatccctgtagtcctcggaagaccttgtttccaggaagtgctccttggcccccaacctgttgcagcaggagctgtgtcttactgcccgtgggacctcacgcacataccagcagactggctgctatgttagcaccattctagttggtgagacctcgaagctttcagaagccagctctgttctggccttgttatctcctgcagccaggtgtcccaggagctgactcagagctatggactcctcctccctaagttgcgggggcgggggggggggtcgtcttctgctaaactgcttcccagcctgttggcatgacaaatctggaggtctttgttgagtagaatgtcaataaagccatccggacagctgct

SEQ ID NO: 4291 - DNA, 2004 bp, Rattus norvegicus
  Genbank Accession No. NM_144755
ggtgccgcagcactttagcagcggaagcggctgctgttgagtacgtgacggctggggtctggcacgggcgtgctgggactccgagataggctcagtgaggctggcagcggtccacgggcgcgggcgcaggcggctctgagacctcaggacaagatgcgagccacatctctggctgcttctgccgatgttccctgcaggaagaaaccgttggagtttgatgacaacattgatgtcgagtgtccagtcttaaaacgagtgagagatgagcctgagcctggaccaacccccagcctacctcccgcctcagacttgtcacctgctgtggcccctgcaacccggctggggccctatatccttttggaacgagagcaaggcaactgcacctatcgggccctgcactgccccacaggcacagagtacacctgcaaggtgtatcccgccagcgaggcccaggcggtgctggcaccgtatgcaagactgcctacccaccagcacgtggcccgtcccacagaggtcctgctgggctctcagctcctatacacctttttcacgaagacccatggggacttgcacagtctggtgcgcagccgccgcggtatccccgagcccgaggctgccgcgcttttccgacagatggctagtgcggtggcacactgccacaagcacgggctcatcttgcgcgacctcaagttgcgtcgatttgtcttcagcaactgtgagaggacgaagttggtgctggagaacctggaggatgcctgtgtgatgactggaccagacgactctctgtgggacaagcacgcgtgccctgcctatgtgggaccagagatactcagctcccggccatcctactccggcagagcggctgatgtctggagcctgggcgtggcgctcttcaccatgctggctggccgatacccgttccaggactctgaaccagccctgctctttggcaagatccgtagagggacctttgccctgcctgagggcctatcagcctctgctcgatgcctcatccgctgtctcctccgcagggagccttcagagcgacttgtggccctgggaatcctgctacatccctggttgagggaggattgcagccaagtctctcctccacggtctgaccgaagggagatggaccaggttgtcccagatgggccacagctggaggaggcagaggaaggggaggtggggctgtatggctagagccaccttaactggcccttcagctccaaggtgtgagttgagtactggtgtctcagctttcgcctgcctttttgggccaagctaaactgtaagtgcctttctggaggaagaaacagccattgtgcttcatgcattcctgtgcacagtggggtgatgctgtctggatgacaagccctgttctaggtgctgtgaacagcaaagaaaaaaaaaaaagagggagaagcataccttgctggccgagttaccacagtgccacatgctccccaggccagcatctaccctctgcccggggcatatttcataccagggctgggccttctctggtctggtgctaggcttctgttcatgggacagtccctttcatcagtgccccagctgccttctgtcttgtgcctttaaacaaagggaacatctctgtgccaaagaccaaagtccccattcaccctgtgccttggggccacaagtgaggccaagctgggattgtggcctccaggcaggagaacctgcttgaagacctggctgctggactcaagccaaaaggatgagactccaataaagaggcatctggctcaaagaatggtctagaatgaggatccaggtctgtctaccctggtagcctccagctggagcatcaaagttggagggggaaggaccaggcagggactgtcctattgccatttagagtctcaggccctgctcttgggattcttagtatccaggactgctgtcagtttgatgactttggtttggttgagtatgtattttcaccatgtgcccaataaaagagagctgtgtggtttt

SEQ ID NO: 4292 - DNA, 3326 bp, Rattus norvegicus
  Genbank Accession No. NM_144757
acttccgggtttagccggcagcgcagccatttgtgtgtgtgtgtgtgtgtgtgtgtgtgtatgtgtgagtgtgtgtgtgtatgtgtgtgtgcgtgcgtgtgtgtgtgtgtgtgtatgtgtgtgaaggcgccttcagtggcccggctttgtggctgggctcagtctgcacggagcgacctagcggatgctgactcgaagtggaggccagaccccggccactcgaatcatgtcggatgtgcttcaggatcggggcaggaagcgcttggcaccacgccacacccggaggggaccatggagcagcaagatgatgagtccccggagaccctgcaggcctgtgtggagaactttgttctaccccaagagatgatcatcgaagtggagggagaagatgctgggtcactggacatcttgcctcaggagagcacagacttcaagattgtgactgtggacctcacggaggagggacagagcacttggagcaaggcccagagaaccccagagagacctgtgaccctggcaggccctggaagggacctgtgggattcgacagctgtacacagaacagaagaaacaacctcaaagcagaccgtctttgatgaagaaccatcccatggatcgaagccagaggtgttggcaagagatgatccttggctttcttcatgtgaggagcagttggagaaacaacaggacaagcaagaggagggggtcttgacccagggtagtgctggtcctcccgagactgtctatggggatcctggctttgacaggagttgcctgagtaccagccggccttcattccccatgatacctctcagaaaccattttcataaacaagcgtcacatgttaaaaagttacatggtgatgttgcaaatagtcaccaacagatcaacaacaatgcggatttctttgaagatgacaaatctgggaaagttcctcagagtcttcatcccactcagtgtataagaaccccgaaaggaaagaaagcctgtgaatttaatggtcgtgttcaaccctttggccaaggtgtgcccctaaatctaaatcaaaaagttcatttggaaggtaaaagctttggctttaaagggcgcgggcaagttttgaaccgtaacatagtcctcaatgagcaacagaagcttctcattaaagaaggccagtataaatgtagcaaaaccgccccaagtccgtctcttccccaaaacctgagaaactactctgaggagaaacgctttgaatgtaagtactgtggcaagtccttcagctggagctcccatctcattgctcaccaaagaacccatacgggggaaaagccgtacaaatgcaacctgtgtgggaagttcttcacccggagctcacacgtcgtttctcatcagaggattcatactggagagaaaccatacaggtgcaatctgtgtgggaagtctttcacccagaggtatgtgctcgtggtgcatcaaagaactcacactggcgagcgtccttatgaatgcaaccagtgtgggaagtcgttccgccagagctacaaactcattgcgcatcaaagaacccacacaggagagaagccgtacgaatgcacccagtgtgggaagtcattcatccagagttacaagctcatcgcgcatcagaaaattcactctggagaaaaaccttatgagtgcagtcactgtggcaagtccttcagccaaagctataagcttgttgcccatcagaggactcacacaggagagaaacccttcgagtgtaactactgtgggaaatcattcagctggagctcccagctggtgtctcatcaaagaacccacacgggagagaagccttacgagtgtaacgagtgtgggaaatcattcaatcgcagctcacaccttgtcatgcaccagagaactcatactggagagaagccgtatcagtgcaagcagtgcgggaaatctttcagtcagagttacgttcttgtcgttcaccagaggacacacactggggaaaagccctacgagtgtggccagtgtgggaagacattccggcagagctcctgctttacccagcatcagaggactcacaccggagagaagccctatgagtgtaatcagtgtgggaagaccttcagcctaagtgcccggcttatcgtccaccagcgaacccacactggggaaaagccctacaaatgcagccagtgtggcaaagcctttattagcagttctaagcgcagtaggcaccaggctactcacagcgaggagtcctgcaagtcctgaccagttgagagtctgagctggagttgactcctgtcagtccaatcctctgaagttccgtctgaaggaatgcacttgaccagaagtgtcagtgtgagaagaatgcacacaggcctttcctcaccccgtgtcagtgacagaaaggagtaagtaaggccttcggtttggcagatgtggataagaggtccctgtagaagaaaagctgttacaccctggcagtggcgcgtactaggatgactgcaggcatcgtccctaagccaatctcaaaaggccacctttaactgtcagaaatcgtttcccaaagcactctgtgtacagagaaggcagaagctagacttagaaaaactgaatgctagatcaaatactgcaagcttagtgcagaagccctcttgttggtgagttcggcctggtccttgagagcacagcttctctgttgcaaagctggcaccctgtagatttcgttcaggaggtgtgcattctaaatgctcttacttagggaagttaactgctggccagcagctttgctctcctcctgctggctcttttccttcatgctactaggtggctaagccacgacctcccgccttatccccccgtgcagagtcctcatacctactcacttcaggcaggtgagccattcgatccctcatttatgcaggcttaaccagtcaggttccagtcatagccaaacgtaagctcacttcggagtaccctactgctcttcaaaggagctgcttttctatcgcaaagatttctcttatgctgtccttactagtcattccgtgccatcaggagacaacataggagtcactgccttagagtgacaggtggccattgagttgtcggggccctagtctgctaaaccaagctcatctgagccaaggaatggactcccttgtcctcaaagccccctacagtattgctgtggatgctggccatgagctggaagggtcaggaaatccacaagcagggttaagcttggaccagcatggaggtgaacctgtgctaaaaacccatgactagtgaggctgagtcaagaggcttgttcaagccagcctgtgttacatagcaaaactgtcttgaaa

SEQ ID NO: 4293 - DNA, 2730 bp, Rattus norvegicus
  Genbank Accession No. NM_144758
accgggtccttagggaaccagccatggagggcgagcgggcgccgctgttaggttcgcggcgtgcggcggcagcagctggggtgtttgcggggcgtcgtgcggcgtgcggggcggtactgttggccgaactgctggagcgcgcggccttctacggcgtcacggccaacctagtgttattcttgaatggcgcgccgttcaactgggagggcgcgcaggccagccaggcactgctgctcttcatgggcctcacctacctgggatccccgttcgggggatggctcgctgacgcgcgactcggccgggcgcgcgccatcctgctcagcctggcgctctacctgctgggcatgctggccttcccgctgctggccgcgccccgctcgcgctcttttctctgcggggatccgcacccggagctggtgcgcaactgctcggctcccttccctaacggaacggcggtctgtcccgatgctgccgcgcgccgctgtgctcccgccaccttcgcgggtctagtgctcgtgggactcggtgtggccacggtcaaggccaacatcacaccctttggagcggatcaggtcaaagatcgaggtccagaggccactcggagatttttcaattggttttactggagcattaatttgggagcaatcctgtcattaggaggtattgcctatattcagcagaatgtgagctttctcacaggctacctgattcctacagtctgcgtggccattgctttcctggtcttcctctgtggccagagtgtcttcatcaccaagcctcctgatggcagtgccttcactgacatgttcaggattctgacctacagctgctgctcccagagaggagggcagcggagaagtggtgaaggccttggagtctttcagcaatcttctaaacacagtctgtttgattcatgtaagatgtcgcgtggagggccgttcacagaggacaaagtggaagacgtgaaagccctggtcaagattgtgcccgtgttcttggctctgattccttactggacagtgtatttccaaatgcagaccacatatgttttacagagtcttcatttgaagattccagaaatctcaagtatcaccaccacccatcacacgctgcctgcagcttggctcaccatgtttgatgcggtgctcatcctcctgctcatcccactgaaggacaagctagtggacccggtgctgaggagacacggcctgctcccatcctccctgaagaggattgccgtggggatgttcttcgtcacatgctctgcctttgctgcaggaatcctggagagtaaaaggctggacctggtgaaggagaagaccatcaaccagaccattggtggtgtggtctaccatgctgctgacctgcccatctggtggcagatcccacagtatgtgctcattggcatcagtgagatatttgcaagtatagcaggtctggagtttgcgtactcggctgcccccaagtccatgcagagtgccatcatgggactcttcttcttcttctctggcattgggtccttcgtgggctcaggactgctggccctggtgtctctcaaggccatcgggtggatgagcagtcatacagactttgggaacatcaacagctgccacctgcattactacttcttcctgctggccgccatccagggagctacgctgctgctcttcctcattgtgtctgtgaagtacgaccgccagcgagccaggacagatggggggacagccagcacgaggacctgatgcagccagccagcatgctcacaggttctgcagactataaggcctcagggcttgctaactaccagggcactgccagcaagcaggttgaggctagatggttggtgtcccaacttctgaacttgcatgttgtctggactggcttctccctccctgtgcccagatgatggtggtgagtgccttactgtggcccgtctcatgtgcactgggcctaccaggagatgagaatgtggcttctctcactgaaggtctctgcccgttctgagccagccatgctttctcttttagaatcctgagcagcccctgtcctgctgctgggcatccttattccttacaaacactgttactttcatagcatctcctgtaagattagcaagcatttccatcaagcggtaggaggattctcttcagagatcaaagtgtggttgatggcgagagagccccatgagctgtttctgctccattgatggtctcttgtcacagatcttgctgatgccaaggcctttgtgggtcagtagtgtagactcatctgctcaaaaagtagttttgttggctaaggtgaagaagtgtttcttattacactaggctggcctcactaggctgacctcaaacttggtgctgcctcctgtctgcttctcaagtgctaagatctcagatgtccatcaccatggtcagcaggacttaggtcatgaactactgatctgctttaagcacatgcatcagtggtgagtgaggacaccatgttctcactgagaccagacagcagctggcaggagattggcatttacacctggcagatcttttctgagaacttgactttgtgtagcagtaagattggaggcaggtggtgagtggggaaaacacgggagctgttgggctggtcgcccacctttgtattgttactgacatatctggggttctgagtgtgtcaactaaaccattttatgtgttgctgtgtcttgtataatttgataaaagcttctcagacatg

SEQ ID NO: 4294 - DNA, 1851 bp, Rattus norvegicus
  Genbank Accession No. NM_145082
  misc_feature (1)..(1851): n = a or c or g or t
ggccaactgcagagccagaagtgagagaggcagacagtgatgtccggagacggggtgtctcagcggagccagagcccttgacagagaaggctttgagagaagccagctctgccatcgacaccttaggcgaagccttggtggctggggcctattctaagatgtggtcctgtcgagaagatgcactgctggcattgtacaagaggctgatggagatgcctgttggaacccagaagggatttgtgaaaaacatgctcagagcatctgtctttctcatcagaagagccataaaggacattgtaacctcagtctttcaggcttcactgaaactgctgaagatgataattacacagtatattcccaagcacaagctgggcaaacttgacacaacgtactgtgtggagagagctatcccccttttacttgccagaactggagactcctctgcccgcctccgtgtcatggccttgaatttcatccaggaaatggccttgtttaaggaggtgaggtctctccagctcattccgtcttacttggtgcagccgctgaagaccaatgcttccgttcatctggcaatgagccaggtggacctcctggcccggctgctgagagacctgggcactgagggctcaggcttcaccgtggacaatgtgatgaagtttgcagtgagcgccctggagcacagggtatatgaggtgcgagagacagcagtcagaatcattctggacatgtacagacagcacccagccctcaccctggagcaccttcctccagacgacagcaccacacgcaggaaccttctctacaaagccatatttgaggggtttgctaagatagatggcaggccgaccgaggctgaaggcaagacccagaaaagagtagtcacaaaagaagcagaaaaacaaaagaaagaagagacgaaggctctacagggcctgtcagcagcaccaagagagacccaggctggagtccaggagaaggagaatgaggctgtgaagctcaagaatcaagaccctcaaggaaggaaagctgccccacctgacactccagaaatcccagataaccactatttggataatctgtgcatcttttgtggggagaggaatgagtccttcacagaagagggcctggacctccactactggaaacactgcctcatgctgaccagatgcgaccactgcaggcaggtggttgagatatccagcctgactgaacacctgctgacagagtgtgacaaaagggacgggtttgggaagtgcccccgctgcagtgaggctgtccccaaggaggagcttcctaggcacatcaaaactaaggaatgcaaccctgccaagtcggagaaggtggcaaaccgctgtcccctgtgtcatgagaactttgctcctggagaagaggcatggaaggttcatctgatgggctctgctggctgcacaatgaacctgcgcaagacacacattctctgcaaggctccagccccgcagcaagggaaaggcccaatggcgtcgaagtcaggcacctcagcacccaaggttggaagcaagatccccaccccaaagggaggcctcaaatcatgagtttctgcagaggtgactggcagacagtattgcanccacaaagctccacatctctgtgcttgattcagggaaggagctacgtacccccagcccttcataatatctaagtggatcactcctcaaaccttcacgtatagaataatatatttttattgttgctgtttgagggtttatgtgctaatttgccttgtgtacactaatacagtaaagatccgaaaggacaagagaaatggagcctccttaccataagtgctcccaaccaatttatgaaaaaaatccc

SEQ ID NO: 4295 - DNA, 1855 bp, Rattus norvegicus
  Genbank Accession No. NM_145084
atgtggatcactgctctgctgctggtcgtgctgctgctggtggtcgttcacagggtttatgtgggccttttcaccggaagttccccgaaccccttcgctgaggatgtcaagcggccacctgaacccctagtgaccgacaaggaggctaggaagaaagttctcaaacaagctttctcagtcagccgagtaccagagaagctggacgcagtggtgattggcagcggcattgggggactggcctcagctgcggttctagctaaagctggcaagagagtccttgtgctggaacaacacaccaaggcaggcggctgttgtcatacctttggggaaaatggccttgaatttgacactggaattcattatattggacgaatgcgggagggcaacattggccgtttcatcttggaccagatcaccgaagggcaactggactgggcccctatggcctccccttttgacttgatgatactagaaggacccaatggccgaaaggagttccccatgtacagtgggaggaaagaatacatccagggccttaaggagaagttccccaaggaagaggctgtcattgacaaatacatggagctggttaaggtggtggcccatggagtctctcatgccatcctactgaagttcctcccattgcccttgactcagctcctcaacaagtttgggctgctgactcgtttttctccattctgccgagcgtctactcagagcctagctgaagtcctgaaacagcttggggcttcccctgagctccaggctgttcttagctacattttacccacttacggagtaacccccagccataccaccttttccttgcacgctctgctggttgaccactacatacaaggggcatattacccccgacggggctccagtgagattgctttccataccatccctttgattcagcgggccgggggcgctgtcctcaccagggccaccgtacagagtgtgctgctggactcagctgggagagcgtgcggtgtcagtgtgaagaagggacaagagctggtgaacatctactgcccagttgtcatctccaatgcgggaatgttcaatacctatcagcacctgttgccagagtctgtccgctacctgccagatgtgaagaagcagctgacaatggtaaagcctggtttgagcatgctgtcaattttcatctgtctgaagggcaccaaggaggagctcaagcttcagtccaccaactactatgtttattttgacacagacatggacaaagcgatggagtgctatgtctctatgcccaaggaaaaggctccagaacacattccccttctcttcattcccttcccatcaagcaaggatccaacctgggaggaccgattcccagaccgatccacaatgactgtcctggtacccacggcctttgaatggttcgaggagtggcaggaggagcctaagggcaagcgaggtgttgactatgagaccctcaaaaataccttccgggaagcctctatgtcggtgatcatgaaactgttcccacagctggaaggcaaggtggagagtgtgactggaggatccccactgaccaaccagtactatctggctgcacaccgaggagctacttatggggctgaccatgacctggctcgtctgcatcctcatgcaatggcttccctaagagcccaaacccccatccccaacctctacctgacaggccaagatatcttcacctgtgggctgatgggggccctgcaaggggccctgctgtgcagcagtgccatcctgaaacggaacctgtactcagatctgcaggctcttggctcaaaggtcagggcacaaaagaagaagaagtagtctattcagagatgagctagaggaa

SEQ ID NO: 4296 - DNA, 2310 bp, Rattus norvegicus
  Genbank Accession No. NM_145092
tagaatcgaaccgcggaaagtccatcgtccctatcgaccaacagctacgtaaacaactatggcgggagagaggtggcgggccgaggggctgggagaaggatgggccatctacgtcacacccagagcccccatccgggagggaaggcggaggctcgccactcaaaatggcgacgggagtgacgcgcctgcgtacgaaactcatccgtcgcgccacggacgacgggaagtgaggttttcagaagagccgccagaagtgtacggcgacttcgagccccgggcggccaaagaaaggtctccgggggaaagacgaaccccgccagaaaagttccggtcggattctgcgaaagaggaagtgagagaaagcgcttacaatcttcggtctcgacaacggaggcagcggggaccccaggaagccgaggagatgaagacgcggaggtctactcgtctggagcagcactcacagcaggcgcagcagcagctgtcaccggctacgagcgggcgaggattacgggacgctcagtccttaagtgaggaccgcggagaggatgaaccttcttcccaacctgttacaagccaaacagtctcaaagaaaactgtcaggacaccagagacttcagtgatgagtgaagatcctatcagtaacttatgcagacccccattaagaagcccaagacctgacgcttccattgtccaacacatcaacccctttgaggaagatgaagccgcagtagcagccggtcaccatccagactcactgtgggggttaccacacagtcggggggacttcacagctcatgagaatcaaccctcactgctgcccacaggatgtcaaaaaaaccctcaagagtgggttgaacaagctgtgagaatgaggactagaatggcatataacaacattcagaaatcagactttggaaaccaatctccatcaacctccaggcaacaagcagctgtacaacccccagatgagtcttctgtcaagataaaatggtggctgctgatacttgttgctgctctggccatgggaatatattggttctttcatactcctgtagtagaaatcactgcagctcaggatgctgcggaagtgctcaagtgtctgagtgaacagatcgccgatgcctactcttccttccgcagtgtccgtgccatccggatcgacggagcaggcaaagctgctcaagacagtgacctcgttaagcacgaagtcgatcaggaactgacagatggatttagaaatggccagaatgcagctgtggtccaccgcttcgaatccctgcctgcaggctcaaccttgatcttctataaatactgtgaccatgaaaacgcagccttcaaagatgtggccctcgtcttgacggtactgttggaggagcagacgctggaagccagtctaggcctaaaggaaattgaggagaaagtgagggatttccttaaagtcaagttcaccagctctgacacggccaactcctacaaccacatggacccagacaagctcaatggactctggagccgcatctcccacctcgtgctgcccgtgcagcctgagaatgctctgaaagcaggcagctgcttatgagggaaagaagcggaaatcctgtctcgagtttgaaccattttcagactttgtaaccagagacggattttggagcagtttttgaaaactggtttctttttaaaggaagtaaagttcatacataaaggtggaataactaaatcatttatgcagcctacttctctgtgatttgggagaatcgtttttctatttccacctagaaccatgttaaagatatttagcatagtgcacagtatatgcagtccccgagtgtctgctaccttgattctggccgaatcattcttgctgtgtgaccagcgagaagggctaggttcctctctcaagcaatcagctttctattgaattttggatttgtgtttgtgaccttattaatgtctgacaaccccctaattgtagctatggatttccctgttacttcttctctcataccattgaaatgtgtggtccttagtttctacctataaaaataaaactgggtgtgcagtttagccagcccctcccccactggtttgtagagagggagacaagggtgtgggaggtagaaagagaagagaaattgtttaatagggaagggaaggaaggaaggtaaaaagatgttgcaagctgggcatggtaagccagcctgttatcccagtattgtcccagtagtcaggaggagcagaggttcaaggtcagcctcatctatagagtgagttttctgccacctggactacatgagacactgtcttaaaaac

SEQ ID NO: 4297 - DNA, 1487 bp, Rattus norvegicus
  Genbank Accession No. NM_145096
cacgagcggcggagcagcgggagtccgcggcgcccgctcgccgccgcgggatggggagctagcgccacggcggccgcggtggccgcagcacagccggccgccgcccccgggcctgtcccgccgggtgctccgggagccccgagcccggccccgagccaggcccgcgggcggcggcggcggaggagctgggcaggtgtatgcggctggaagatggcgccctcgggccccggtggcgtgaggcggcggtgccggcgggtgctctactggatccctgtggtgttcatcagcttgcttctgggctggtcctactatgcttacgcgatccagctgtgcatagtgtccatggaaaacattggtgaacaagttgtgtgcctcatggcttatcatctacttttcgcaatgtttgtctggtcatactggaaaaccatttttacattgcccatgaatccttcaaaagaattccatctctcttatgcagagaaagaattgctggagagagagccaagaggagaagcccatcaggaagttctgaggcgagcagccaaagaccttcccatctacaccaggaccatgtccggcgcgatccgatattgtgacagatgccgacttataaagccagaccgctgccatcactgttccgtctgtgataaatgtattttgaagatggaccatcattgcccatgggtgaacaattgtgttggattttcaaattataaattcttcctccttttcttggcttactctctgctgtactgccttttcattgctgctacagatttacagtattttatcagattttggacaaatggtctccctgatactcaagccaagttccatattatgtttttattctttgctgcagctatgttttctgtcagcttgtcctctctttttggttatcattgctggctagtcagcaaaaataaatctacattagaggcattcagaaatccagtatttagacatggaacagataagaacggattcagcttgggtttcagtaaaaacatgcgacaagtttttggcgatgagaagaagtattggctgttaccaatattttcaagtcaaggtgatggctgttcctttccaacttgccttgttaaccaggatcctgaacaaccttccactcctgcaggactaaattcaacagcgaaaaatcctgaaaaccatcagtttcctgcaaagccgttgagagagtcacagagccacctccttacggattctcagacctggacagagaacagttcaaactccgggagatgcaaagccggtatgagcaaccctgcattaactatggagaacgagacttaactctacaatcaaaataaaaccactcttgtaaagtaccaaggctgtggaagactggaacaagcttccaattggatggcaccattggccaattgtccctttggctaaatatgcgaattttgtcttcagtgatggggatcaaacacagcactatcaagaatttcaagtaatcaccaaac

SEQ ID NO: 4298 - DNA, 1285 bp, Rattus norvegicus
  Genbank Accession No. NM_145097
tgagagacccagcatgcattatactcgctgtctgctgcttctcctggctggactcttggaactctctcacagtcagccagaccaagaagagcctgacaatacaaccaaccaaacctacagacagttctcacagcagaacatctccagctaccagattgcctctggcaatgccaactttgccttccgcctctaccacctgatagcgtcccaaaactctgagaagaacattttcttctccccactcagcatctctgtctctttggccatactgtccacaggggctggtggggacacccaggctcagatccttgaaggtctgggcttcaacctcacaaagctgtcactgcctgaaattcatgagggcttcaggtccttgcagcacacaatagctcgcccattcactgagccacagatctctgtaggcagtgcgctgatcctgagccagaacctgcagatcctctctgagtttgtcagtgccatcgaaacctcctataacagcaaagtcttacatgctaacttcagagataaggaggctgcggtccagctcatcaacaactatgtcaagcagaatactcaggggaagatcaaaaatttggtcagtgacctgagcccagatgtaaagatggtgctggtgaattacatcttcttccaaggtctttggaagaaaccctttccttcttccagagtctctaccagtgacttctatgtagatgagaacacggttgtgaagatacccatgatgctgcaagataaggaggatcactggcatcttgaggacagacgtgtaccctgcacagtactgcggatggactacaggggtgatgcagtggcgttcttcatccttcctgaccagggcaagatgaatgaggtggagcaggtgctgtccccaggcatgctactaaggtggaaacgcttgctgcagaataggttcttttacagaaagctcatattgcagctccccaaattctccatttcaaattcctatgaattggatgagattttgcctgacttgggcttccaggatctgttcaccccaaatgccaacttctcaaatatcagcaaaaaggagaaattgtacttatccaaagttttccataagaccgtcctggatgtgaatgaagttggcacaaaggcagcagcagccaccggctcctttgccacctttttctctgcccagcccaagaaacgttaccttatattcaaccggcccttcttggtgatattgtattccaccagctcccaggatatcctcttcatggggaaggtggtcaaccccacagcatag

SEQ ID NO: 4299 - DNA, 386 bp, Rattus norvegicus
  Genbank Accession No. NM_145672
catgaagtccgttgctctattcctcatgggcatcatcttcctggatcactgtggagttcgaggaaccctagtgataaggaatcagcgatgctcctgcatcagcaccagccaaggcacattccactacaaatccctcaaagacctcaaacagtttgccccaagccctaactgcaacaaaactgaaatcatcgctacactgaagaacggagatcaaacctgcctagacccagattcagcaagggtgaagaagctgatgaaagaatgggagaaaaagatcagccaaaagaaaaagcaaaagagggggaaaaaccatcaaaggagcaagaaaacccgaaaagctaaaacaccccaccatccggagtcaaagaagactgcataagagacca

SEQ ID NO: 4300 - DNA, 3150 bp, Rattus norvegicus
  Genbank Accession No. NM_145677
ggcatatcttgtgctagtttcccaggaacccggcattccctactcttgacttctgccggcacttgctcctggtggtagctgagcaccgggtctcaccagcatgctctgcctgtgcctgtatgtgcccatcgctggagaggctcagactgaattccaatactttgagtccaaggggcttcccaccgagctgaaatccatcttcaaactcagtgtctttatcccctctcaggagttctccacataccgccaatggaagcagaaaattgtgcaagcaggtgacaaggaccttgatgggcaactggacttcgaagagtttgtacattacctccaagaccatgagaaaaaactgaggctggtgtttaagagtctggacaaaaagaatgatgggcgaatcgatgctcaggagatcatgcagtccctgcgggatctgggtgtcaagatctctgaacagcaggcggagaagattcttaagagcatggataagaatgggacaatgaccatcgactggaacgagtggagggactaccacctcctgcaccctgtggagaacatccctgagatcatcctgtactggaagcactcgacgatcttcgatgttggtgagaatctgacagtcccagatgagttcacagtggaggagaggcagacagggatgtggtggaggcacctggtggcaggaggtggtgcaggggcagtttccagaacctgcactgcccccctggacagactgaaggtgctcatgcaggtccatgcctcccgcagcaacaacatgtgcatcataggtggattcacacagatgattcgagaagggggcgccaagtccctctggaggggcaatggcatcaatgtcctcaaaattgcccctgagtcagccatcaagttcatggcatatgagcagatgaaacgccttgttggtagtgatcaggagacgctgaggatccacgaaaggctagtggcaggctccttggctggggccattgcccagagtagcatctacccaatggaggttctgaagacccgaatggccctgcggaaaacaggccagtactcgggaatgctggactgtgccaagaggatcctggctaaagagggtgtggctgccttctataaaggctacatccccaacatgctggggatcatcccgtatgcgggcatcgatctagctgtctatgagacattgaaaaatacctggctacagcgctatgctgtaaacagtgcagaccctggcgtgtttgttctcctggcctgtggcacaatctccagtacctgtggccaactggccagctacccactagccctggtcaggactcggatgcaggcacaagcctccattgagggtgcacctgaggtaaccatgagcagcctcttcaaacagattctgcggactgagggggcctttgggctctaccgggggctggcccccaacttcatgaaggtgattccagctgtgagcatcagctacgtggtctacgagaacctgaagatcaccctgggcgtgcagtctcggtgacgggagggtggcggacttggtgaccctgggctgcagcccagggtgtgcagccgcctcattctgtgaatgtgccaacactaagctgacttacccaagctgtgaaacccaggatgctgcaggggacgggcagggagctgcaagcgctgggctggtcctgctgacctggcagacctttgtgtctcttccaaggaagacctgtggacattccttggggtccaggggtcagtaagatgtgggctcctgcacctagagacaggacgttttccacagtgcctgccaggtagcgagcttggatgccagcttagctcttccatctcgtcacgcaacctgacctcagccatggcatccctctggtccaaagagcattcctgtgcccctcatctcttcccactgatgcgctggggtaggaagtgggcccacccccactcttatccttctgtccatcttccctcagtgctgctcttccaaacctggttcccaagctgtagcatccatgaggactgtggtacgggaagctggagaagtaccattatgtcctcgctcgcctattctgagctcaccagcaaggccacctggatgcgcccaggtcctcaggcaccggctgcctgacaccatggtgcatggctttgctaaaagctagtgctagaacctggaacccagaggatttgtgctgcctgcatgggcctaatgtcctctgagctgcccctaaaccctgtcaggactggcaccagctcgtgcccacactcatggtggttctgtggtgagagggtgggcagggtgtctgctccaggtctgctgctctggtgagaagatgctgaaggccttaattatgtcttactgggtaaaggatttggttcagaaggacaagctggacactgcacgtgccacactttcagagagcctgggggaaagtgtgttctgagggccctgtggggccaagggggaccagcctcacattccacacgtgtgccactctgcttggagcctatttattttgtatttatttgaacagagttatgtcctaactatttttatagatttgtttaattaatagcctgtcattttcaagttcattttttttattcatatttatgttcatggttgattgtaccttcctgtcaccagctggtggggcatggggagacaaggtagaaaagtggccacagagtgaccttacctgctgcccacactgacggcatgtccgtctcacaggaaacagaaggaaaggcacagggaggactcttcaggccaggtagggtagtgggaaaggtggcgacttcttgacattctttcctggaccgggaggttttctttattttgcccttttggaaaacacggcagtgaggtgcttcattcaccaggaatttggtgtgagggtgaggactgaagggcctgccttccccaacctgtgacctggtctcgctcctggcccgagactgcccatgctcaatgagtggccagctggccacttggcaatcatgcctccattgccccagaatggcctgatgaggaaaatccaaataggatgcaaagatcaatgcaaaagtcaccagtctgcatagtctgtgctgtaactggagtttgtcaaagacgagcaaccttctaataaagtcgcttcaaatgtgaaaaaaaaaaaaaaa

SEQ ID NO: 4301 - DNA, 2032 bp, Rattus norvegicus
  Genbank Accession No. NM_145683
agacggactgacagacagctggcaagaggcagccctggggacatagctgcttcagcaggcctcatggctgagtgagcctcccttgggcccagcaacctaccccagcatggtccaggcctgtgaggggcgctccagagcacagctgccgaccttgtctttgggggcagacatgactcagcctccacccgccaaagctccagccaagaagcatgtgcggctgcaggagagaaggggctccagtgtggctctgatgctggatgtgcggtcactgggcactgtcgagcccatctgctcagtgaacacaccccgtgaagtcaccctgcacttcctgcgcacagccgggcacccccttacacgctggactctacagcaccagcctcccagccccaagcagctagaagaggaattcttgaagatcccctcaaactttgtcaaccctgaagacctggatatccctggccatgcctccaaagaccgatacaagaccatcttgccaaatccccagagccgtgtctgtcttggccgggcacacagccaggaggacagcgactacatcaatgccaattacatccggggctatgatggaaaggagaaggtctacattgctacccagggccccatgcccaacactgtagcagacttctgggagatggtgtggcaggaagatgtatccctcattgtcatgctcacccagctccgagagggcaaggagaaatgtgtacactactggcccacagaagaggaagcctatgggcccttccagatccgcatccagggcatgaaagagcacccagaatatactgtgaggcacctcaccattcagcaccaacaggaatgccggtcagtgaaacacatcctcttctcagcctggccagaccaccagacgccagaatcagccgggcccctgctgcgcctggtggctgaggtggagaccccagagacagctgccaactccgggcctatagtggtccactgcagcgcagggatcggtcggacaggctgcttcatcgccacccgaatcggctgccagcagctgaaggcccgaggggaggtggacattctgggcattgtgtgccaacttcgcctagacagaggaggcatgatccagacggcggagcagtaccagttcctacaccacactttggccctgtatgcagcccagctgcccccggagaccgacccctgacccctgacccctgacccctgacccctgaccctccaccagcccagggaccaaccttctctcaggtcagggacagtgggtctggggaagtgggctgtgcgctctggcatggcttctgcataagcacaggaaagggagccttggaagcaagaatgttttacagtctcaggaaactgccccagcaagcaacaggggccaggccgtaggtcttcgccacagaccatgactctgccttcttcagtggcccccggtggactccaggggagcttccctaagtggctctgaacttacagataggagctggtccttgaaatggattgagaaagcggctgaggcactggcttgtctttgtgcttcctgtgggctcctttccttgtcggtgacacagagtcagtcctttgctgccattgtagaagcagacagaatgttcctgaaagccattccaggtagccctgccgttggggctgcagagatgctgatcgtaagatcctcttccggtaaggccttgcccacacacaggccagatgcaagcgcagggaaaatcccagtctgaccttggtcaaatcctctctattctacatagactgctcctccccatacaccggggggtgctggatgacccgctcagaagagaataaaggccttggttggcccccctccacacctgtggtaaaaggagacgcagaggtaaccaggtccagcagttaggaatccctggaagagcccaggtgtgatgacctacgtactcatcctccagcactcaggagtagaagcaggaggattgctgcaaatttgaggccagctagatctatattttgagtaccaggccagacaggactacatagcaag

SEQ ID NO: 4302 - DNA, 2472 bp, Rattus norvegicus
  Genbank Accession No. NM_145724
gaactaaaaagatcgtgtgcgcggatgtgctgtgtctgtagtgactttttccgggcctcttttttgggagaaggtaccagtctgcctcggtgaggcagaaaaggtccgtgatgccattgggctttgcccttctagaaaacaagctctagctggacggtccagaggctccaatggctgcgggctctggggtcgccccgccacctctcggcgttgggctttgtgcggtgaaagtggaggaggactctcccgggagtcaggagccctccggttccggagattggcagaatcccgaaacttctcgaaaacagttcagacaattgcgctaccaggaagtagccggccctgaggaggcgctgagccgactttgggagctctgtcggcggtggctgaggccggagctgcgctccaaagagcagatcatggagctactggtgctggagcagtttcttaccatcctgcctcgggagctccaggcctacgtgcgggaccactgccctgagagcggggaggaggctgcggctttggcgcggactctgcaaagagcactggacggggcctccctccagagctttgcaactttcaaggatgtggctgaatctctgacctgggaagagtgggagcagctggctgcagctcggaagggtttctgccgagagagcacaaaggaccctgggagtacagttggccctggcttggaaaccaaagctgtgaccacagacgtgattctaaagcaagaaatgtcaaaggaggcagagtcccaggcatggctacaagaagtgtcccagggaaaggtcccagtatttaccaaatgtggtgatacctgggaggactgggaggaacggcttccaaaagctgccgaattgctgccgctccagagttctcctgaagagcaaggacgcactgccatcccgcatctccttggcgtgtccaaagatgaaagcgattctaaagataatgaatttgagaacagcggcagcttggtccttggtcagcacatccagacagcagagggtctggtcaccaatggtgaatgtggggaggatcacaaacaaggcttacatgcgaaatgccacacggtgaagcctcacagctctgttgacaatgctttggggcttcttgagagccagaggcatttccaagaaggcagaccttataagtgtgataactgcgagaagagattcagacagcgctcagacctcttcaaacaccagaggactcacacaggtgagaaaccctatcagtgccaagaatgtgggaaaagcttcagtcagagtgctgccctggtgaaacaccagcggacacacacaggtgagaagccatatgcatgcccagaatgcggggaatgcttcaggcagagctcacacctcagtcggcatcagagaacccatggcagcgagaagtactgtaaatgtgaggagtgtggggagatctttcatatctccagcttatttaaacatcagagactgcataaaggggagagaccacacaagtgtgaagtctgtgagaagagctttaaacagcgctcagacctctttaagcaccagagaatccatacaggagagaagccctacatgtgctttgtctgtgagagaagattcagtcagagtgcaaccctcattaaacaccagcgaactcacactggagaaaaaccttataaatgttttcaatgtggcgaaagatttagacagagtacacaccttgtccgacaccaaagaatccatcacaattcagtctctgggcttagggtggagaagcaacatggtaacctcctgagctggtgaccctctggatgcaaagaatggaaatgccccattcgcctagcgcactgacccatcgagggagaaattgacccctccacagctgcagtttatgcgccaggtacaactagcccagtggcagaaaacactgccacagcggcggacctggaacatcgtgaccccccccccccccgggcatcggggccctggtgttagctatttatggttacaccttctactcagtggcccaggaacatttccttgatgagctggaagatgaagccaaagatgcccgagcccgagctcttgagagagagagagagcatcaggaccctaactgtacggaccatcctgaaactgctggagcccccgtacatgttgaatgatgcctggtggtctcacagcatcactggcataggaactgtggactatgattgagcccaagaagccacagactatgcatttggctactgccaaggggagattgctcacgtcacatgcagtttgtacatttactcagcccctttttatttccttgtttgagaggtatgcacgaccttgcctttccccaaactctgtggtttacctcttcacctcccaggggcccaactgttaagggggagggtgtggcctaactgcagagttggaaccaaagtgggaaagatagggtcaagtaaagagtaattaaaaaaaaaaaaaaaaaaaaaaaaaaaaa

SEQ ID NO: 4303 - DNA, 1420 bp, Rattus norvegicus
  Genbank Accession No. NM_145778
ccggaattcgccatggcgatgccgagagaaatcatcaccctacagttgggccagtgcggcaatcagattgggttcgagttctggaaacagctatgtgctgagcatggcatcagccccgagggcatcgtagaggagttcgccaccgagggcactgaccgcaaggacgtctttttctaccaggcagacgatgagcattacatcccccgggctgtgctgctggacctggagccccgggtgatccattccatcctcaactcctcctatgccaagctctacaacccagagaacatctacctgtccgagcatggaggaggggctggcaacaactgggccagcggattctcccagggagaaaaaatccacgaggacatttttgacatcattgatcgggaggcagatggcagtgacagcctagagggatttgtactgtgtcactccattgctggggggacaggctctggcttgggctcctacctcttggaacggctaaatgacaggtaccccaaaaaactagtgcagacgtactccgtgttccccaaccaggacgagatgagtgacgtggtggtccagccctacaactccctcctcacgttaaagaggctgacccagaacgcggactgtgtggtggtgctggacaacacggccctgaacctgatcgccacagaccgcctgcacatccagaacccatccttctcccagatcaaccagctggtgtccaccatcatgtcagccagcaccaccaccctgcgctaccccggatacatgaacaacgacctcatcggcctcatcgcctcactcattcccacccctcgactacacttcctcatgactggctatacccccctcaccacggaccagtcagtggccagtgtgaggaagacaacagtcctggatgtcatgaggagactgctacagcccaagaacgtgatggtgtccacaggtcgggatcgtcagaccaaccactgctacatcgccatcctcaacatcatccagggagaggtggaccccacccaggtccacaagagcctgcagaggatccgggagaggaagttggccaactttatcccctggggcccggccagcatccaggtggccctgtcaaggaagtctccatacctgccctcagcccaccgggtcagcgggctcatgatggccaaccacaccagtatctcctcgctttttgaaaggacctgtcgccagtttgacaagctgaggaaacgggaggccttcatggagcagttccgcaaggaggacatcttcaaggacaattttgacgagatggacacctccagggagattgtgcagcagctgattgacgagtaccatgcggccacacggccagactacatctcctggggcacccaggagcaatgagtcgcccgagacagggaccctcatctgccttaccggttagccatgg

SEQ ID NO: 4304 - DNA, 4701 bp, Rattus norvegicus
  Genbank Accession No. NM_145779
gaattccggccttttgtggcagcaaattatagattgattgaggagagttcaggggctgagggctcagacctacccttccctgcccctgtccaccatgaggagaaaccagctgcccataccagtctttcttttactgctcctgcttcttcccagagatgccaccgcagctactggaaaaccacgatatgtggtgctggtcccctcagagctctatgcaggagtccctgaaaaggtctgtgtccacctcaaccacctgaacgagactgtgacactcaacgtaactctagagtatggagtacagtactcaaacctcctcatagaccaggctgtggataaggactcctcctactgcagctctttcacgatctcaaggccgctttcaccctcggctctcattgctgtggagataaaaggaccaacgcaccacttcataaagaagaagtcaatgtggataacaaaagctgagagcccagtctttgtccagacagacaaacccatatacaaacctggacagacagtgaaattccgagttgtctctgtggacatcagttttcgcccggttaatgaaacgttccccgtcgtttatattgagaatcccaagaggaacagaatctttcaatggcaaaatgtcgatctaccaggaggactgcaccagctctctttcccactgtctgttgagccagctctaggcatctacaaggttgtagtgcagaaggactcagggaagaaaatagaacattcctttgaggtgaaggaatatgttttacccaaatttgaggtgcaagtaaaaatgcccaagacgatggctttcctggaagaggaacttgttgtaactgcttgtggcttatacacatacggaaagcctgttcctggtctggtgacaatgaaagtatgcagaaaatatacacagtcctactccaactgccatggccaacactcgaaaagtatctgtgaagaattcagcaaacaggcagatgaaaaaggatgtttcagacaagttgtaaaaaccaaagtgttccagcccagacagaaaggctatgacatgaagatagaggtggaagccaagatcaaagaggacggaacaggaatagaactaactggtactggatcatgtgaaatcgcaaataccttaagcaaactgaaatttactaaagcgaatacattttacaggcctgggctgcctttctttggacaggttcttcttgttgatgagaagggtcaaccaatccccaacaaaaatctaactgtccaagtgaattcagttaggtcccagttcacttttactaccgatgagcatggcttggccaacattctcatcgacaccaccaacttcacgttttcgtttatgggaatcagggtcatctacaagcagaacaacatctgctttgataactggtgggttgatgaatatcacacacaggcagatcattctgcagctcgcatcttttccccaagccggagttatattcaacttgaacttgttcttggtactttggcttgtgggcaaactcaggagattcggatacacttcctcttgaatgaagatgccctgaaagatgcaaaagacttaaccttttactacctgatcaaagcaaggggaagcatctttaactcaggaagccacgtgtttccgcttgaacaaggaaaagtgaaaggagtagtttccttcccaattcgagtggagccaggcatggctcctgtggctaagctgattgtctacactattttacctaatgaagaacttattgctgatgttcagaaattcgacattgaaaagtgttttgccaatacggtgaatttgagtttcccatcagcacagagcctgccagcctctgacacccacctgacggtcaaagccacacctctgtccctgtgtgccctcactgcggtcgaccagagtgtgctgctactgaagcccgaagccaagctctctcctcaatcaatctataatttgctgccacaaaaggctgagcagggggcttacttaggacccctaccgtacaaaggcggtgagaactgcatcaaagcagaagacatcactcacaacggcatcgtgtacacaccaaagcaggatctgaacgacaatgacgcatacagcgttttccagtccataggattaaaaatttttaccaacaccagagtccacaaaccacgctattgtccaatgtatcaagcctatccgcctttgccctacgtaggagagcctcaagccttagctatgtctgcaatcccaggagccggctacagatcaagcaacattaggaccagctcaatgatgatgatgggcgcatcagaagtagctcaggaggtagaagtaagagagacagtgcggaagtacttcccggaaacctggatctgggacatggtgccgctggacttatccggtgacggtgagttgccggtaaaggtccctgacaccatcactgagtggaaggccagtgcattctgcttgtctggaactactggccttggtctctcctccaccatctcccataaagtcttccagcccttcttcctggagctcactctcccctactctgtggttcgaggcgaagcatttatcctcaaagctaccgtactcaactacatgcctcactgcattcggatccatgtgagcctagagatgtctcctgatttcctggcagtccctgtggggagccatgaagattctcattgcatctgtggaaatgaaagaaaaaccgtgtcctgggctgtgaccccaaagtcgctgggggaggtgaacttcacagctactgcagaagctttgcagtctccagaactgtgtggcaataaggtggcagaagtgccagcccttgtacagaaggacactgtagtgaagcccgtaatagtcgagcctgaaggaattgagaaggaacaaacgtacaacacactgttatgcccacaagatgctgagttacaggaaaattggacactggatcttccagccaatgtggttgaaggatctgccagggctacacagtccgttttgggcgatatactaggctctgcgatgcaaaacctccagaatcttctccagatgccctatggctgtggggaacaaaacatggtcctcttcgtccctaacatctacgttctggagtatctcaatgagacacagcagctgacagaggcgatcaagtccaaggccattagctacctcatcagcgggtaccagaggcagctgaactatcagcacagtgacggttcatacagcacattcggggaccgcggtatgaggcacagtcagggaaacacttggctcactgcatttgtgctcaaggccttcgctcaagctcagtcatacatctatatagaaaagacacacatcacaaatgctttcaattggctctcgatgaaacaaagggagaacggttgtttccaacagtctggatccctgctcaacaatgcgatgaagggtggtgtggatgatgaagtgacactctctgcctatatcaccattgctctgctggagatgcccctgcctgtcactcacagtgttgttcgtaatgctctattctgcctggaaacggcctgggcctccatctcaaacagccaagaaagtcatgtctacacaaaagcactgctggcctatgcctttgccctggcaggaaacagagccaagcgaagcgaggtgcttgaatccctaaacaaagacgctgtgaatgaggaggaatcagtgcactggcaacgtcctaagaatgtcgaggaaaatgtccgggaaatgaggtccttctcttataaaccgcgggccccttctgctgaagtggagatgacagcttacgtgcttctcgcctacctcacctctgcatcttcccggcctacgcgagacctttcttcatcggacctgactacagcatccaagattgtgaagtggatcagcaaacaacaaaactcccatggggggttctcctccactcaggatacagtggtggctcttcaagccctctccaaatatggagcagccacttttacgaaaagtaataaagaagtgtcggtcaccatcgagtcttcagggaccgtctctgggactctccatgttaacaatggcaatcgcctgctgctgcaggaagtcaggctggcagatctgcccggaaattacatcaccaaagtgtcagggtcaggatgtgtgtacctccagacatctctaaagtacaacatccttccggaggcagaaggagaagcgcccttcactctgaaggtcaacactctccccttaaactttgataaggcagaacatcacagaaagttccagatccacatcaacgtaagctacattggagaacgacccaactccaacatggtcattgttgatgtgaagatggtgtcaggcttcatacctgtgaagccatccgtgaaaaagctccaagaccagtctaacattcagaggactgaagtgaacaccaaccacgttctaatctacattgaaaagctaaccaatcaaaccatgggtttctccttcgcggtggaacaagacattccagtaaagaacttaaaaccagccccagtaaaagtctacgattattatgagacagatgaattcgccattgaagaatacagtgcccctttcagttctgactctgaacaaggaaatgcttaaaaataggaacctatagatttcctcagaaagactcctccacacgtgaagaaccaagacagcaagataaatggaaaggaattaaaaacccataaaatttatatgtt

SEQ ID NO: 4305 - DNA, 600 bp, Rattus norvegicus
  Genbank Accession No. NM_145783
gtggtcgccgtcatgctcgccgctgccctccgtcgctgtaccgcagccgcggccgcccgaggccttctgcaccccgtctcggctcccagccccgctgccgctgtctgttccattcgctgctattctcatgggtcacatgagacagatgaggagtttgatgctcgctgggtgacatacttcaacaagccagacattgatgcctgggagttgcgtaaagggatgaatacacttgttggctatgatctggttcctgagcccaaaatcattgatgctgctttgagggcatgtagacggttaaatgattttgctagtgctgttcgcatcttggaggttgttaaggacaaagcaggacctcataaggaaatctacccctatgtcatccaggaacttagaccaactttaaatgaattgggaatctccactccagaggaactgggccttgacaaagtgtaaactcccttcgatgggcttcccaaggacttaactgctattgctacttgattgaaacagttgcctggaaatgttttatttgaacaaattttcctttgagtatcaaaccatgtaacttggactttaataaagggaaatgagtttgacccg

SEQ ID NO: 4306 - DNA, 2451 bp, Rattus norvegicus
  Genbank Accession No. NM_145784
ggcacgagtggaggcggacccagctgccagctgcctctcttaattccacacagtccttaggtccctcgccctcacctctctgaggcagctgtgccctgctttcctggccatgcggtggctgtggcccctggctgtctctcttgctgtcgtgttggctgtggggccgagtgaggtctctggggctgccaccttatctttgggtggtcatagagccaaggtccaggagcagcagagtcgaccccgaagaggtaccaaggatgaggggcccaaggaggtacagcactatgtacctgaggagtgggctgagtaccccaagcccatccaccctgctggcctgcagcccaccaagcctttggtggccactagccccaacccagacaaggatggggccacctcagagagtggacaagagctgaggaccaacctgaccgggacaccaagtcagaggctgcagattcagaaccccctgtatccggtgaccgagagctcctatagtgcctatgccgtcatgctcctggctctggtggtatttgctgtgggtatcgtgggcaatctgtctgtcatgtgcattgtgtggcacagctactacttgaagagtgcctggaactctatccttgccagcctggctctctgggatttcctggtcctcttcttctgcctaccaattgtcatcttcaatgagatcaccaagcagaggctacttggggatgtttcttgccgagcagtgcccttcatggaggtctcctccctgggagtcacaaccttcagtctctgtgccctgggcatagaccgattccatgtggccaccagcaccctgccaaaggtgagacccattgagagatgccaatcaatcctggctaaactggctgtcatctgggtgggctccatgatgctggctgtgcctgaactcctgctgtggcagctggcacaagagcccactcccaccatgggaactgtggactcatgtatcatgaaaccttcagctgacctgcccgaatccctctattcgctggtgatgacctaccagaatgcccgcatgtggtggtattttggttgctacttctgtctgcccatcctcttcaccgtcacctgtcagctggtgacatggcgggtgcggggcccaccgggcaggaagcctgagtgtagagcgggcagacatgagcagtgtgagagtcagcttaacagcaccgtggtgggcctgactgtggtctatgccttctgtacgctccctgaaaacatctgcaacatcgtggtggcttacctctccactgagctcacgaggcagaccctggacctcctgggcctcatcaaccagttctccacgttcttcaagggcgccatcactcccgtgctcctcctgtgcatctgcaggccgctaggccaggccttcctggattgctgctgctgttgctgctgtgaagaatgtggtggggcatcagactcctcagccactgtcagcgcggacagcaagcttaaggccgaagtgtcctcctccatctacttccacaagcccagggagtcgcccccactcctgcccctgggcaccccttgctgagcccatgggggaacaggagcaggcacagagcaggcaggggaggggggccatgccgatccatggcggtctgctgattctttcacatggtctcactttggcctctctctcatcctgctgtttagagatggacttggcttattttgtcaacgactgggcttttcaaagctccatctacaaacaatgctgttcttaccctcagagggacctgccagccttgtccttcccacttgtagatggagatctgtctagccgttagagttgcccagcatctccatctggccaccctcgagcccgggcaaggccttttgcctgttctccctttggtcttaggatctgactattggctgagcccctccatcatcatgatggatcctgtgttgatgagctccaactattgttggaccactatgatgtcgatgatcatttctctacttctacctagctccctatcctggaccaggcacttctaggggggctcacctaaccaagcccaggattccattttttttttttttggttctttttttcggagctggggaccgaacccagggccttgcgcttcctaggtaagcgctctaccactgagctaaatccccagccccccattttttttttggttctttttttcggagctggggaccgaacccagggccttgcgcttcctaggtaagcgctctaccactgagctaaatccccagccccaggattccattttctaaagtgggtctgtcttagccctgaatgtcccttcccttttcccagaggagtctctcacttctgtcttccgttcttagaggtactgcggttgcattgcctgacccctgcctcccgttaggtgctttcctgtagaaggccattctggaaaaacaataaagtaggtacaacaaaaaaattaa

SEQ ID NO: 4307 - DNA, 1265 bp, Rattus norvegicus
  Genbank Accession No. NM_145790
gcacgaggttttgggttaggtgagatgagggtgatcctcggtagaaacaaaacctgtcattcacagtgagtaagagccctgagaatgagccagaagcaggccatgtgctttttcctttacagttcctgctcttgctttcctacttccaaaagagctccgtgctgaatcttctttgggcagcagagggtgaagaggacgtttccagggttctgataggtccattggcgtgtgtccagtcctagcactgtcgttctggtggtgcccattgcattccgtggtgttttcagaatccgtttcaggagagagttgttgtagttttctttcaacaccattacctcagcttgctggcatttcccatcagccaccagtactgatggaaagtcaacccagattagactactctccactagcccagctttatggggccatccatttgccaaaaggataatagaagcagaccctggatgtaagacagggaacataaaaaaataatttgataatttaaaaggagtgatgggggatggctcagcagctaagagcactcgtttacaaatttggttctagcacccacatggcagctctcaactctctgtaacactagtcccagctgatctgacaccccccttttggcctccacaggcaccaggcaagcacatagtacacagaccttccatgcaagcaaccatccatacatagaacacctaataactatttttaagagcaaatgacatttcttgtagtgagtaatcttggtgtgaacagtacacactacttataagaaatatcttggttgctatgagaactatctctcatgtattcttttcaaactacacatcatttaatctgttcattattaaacaataaattggtcgtggcccttctcttcggccccaggtcattgctccccttgcagcttgttcataaagttattggggcttctccaactgaggtgtggatttgcatgggattgtacagtttgtgtgggagctgcacacttaagttgcccagtgtgggccaccatgtgcattccttcagttggcctttagaaggcctcacagactttggctcaccatgcatgagaccattgaagaggcactgggagggggctggagagatggctcagtggttaagggcactgactgctcttctagaggtcctgagttcaaatcccagcaaccacatggtggctaacaaccatctgtaatgggatccaatgccctcttctggcgtgtctgaagacagctacagtgtacttatatattaat

SEQ ID NO: 4308 - DNA, 664 bp, Rattus norvegicus
  Genbank Accession No. NM_145878
ggcacgagtctccttgctgcttttgtgctctcccgctcgccatggccagccttaaggacctggaagggaagtggcgtctggtggaaagccacgggtttgaggactacatgaaggaactaggagtagggctggctcttaggaagatgggtgccatggccaaaccagactgcatcattaccctcgacaacaacaacctcaccgtcaaaactgagagcacagtgaagacgaccgtgttttcttgcaccttgggagagaagtttgatgaaaccacagctgatggcaggaaaactgagacggtctgcaccttcacagacggtgccctggtccagcaccagaagtgggaagggaaagaaagcacgataacgagaaaactgaaggacgggaagatggtggtggagtgcgtcatgaacaatgccatctgtactcgggtctatgagaaggtacaatgaggactggctaactcgtcatcctggacagcagtcagctggctgagggaatagctcaattcaatgagcaggtcgtacagaaccacactgcttcacttctttggttttatttttcatgacttttcatcatagacactttacccgaaacccatgtcagaccgttggtttacccaggatcattcctttggttagtaaataaatgcgtttgtgctaattca

SEQ ID NO: 4309 - DNA, 1038 bp, Rattus norvegicus
  Genbank Accession No. NM_147136
ggctgctaggcgccggccgaggcgaggcgccgcgcggaaaaccgcggcccggggggcggacccggcgggggaacaccgacgcggaggttccccccacacgcgcgggacacgcccgcccgcccccgccacgcacctcgggagaggcgatgggggggtggagcgaggccccgcggggaggggacccgcgccggcacccgccgggctccccgggagcggccgcgacgcccgccgcagctgaggcgatccacgggaagggcccggctcgcgtccagagtcgccgccgccgccggcccccccgagtgtccgggccccccgccccaccgggggcccgctggttcctcccgctccggaacccccgcggggttggacccgccgccccggagcccgcgccgcgcgccgacccccgacccgccccccgacgggaagaaggaggggggaagagaggtggcgacgacgcgggggacgacggggccccgcggggaagaggggagggcgggcccgggcggaaaggacggggggtctccccggacgtgggagagggcggcggcgcctcgtccagccgcggcgcgcgcccagccccgcttcgcgccccagcccgaccgacccagcccttagagccaatccttatcccgaagttacggatccggcttgccgacttcccttacctacattgttccaacatgccagaggctgttcaccttggagacctgctgcggatatgggtacggcccggcgcgagatttacaccctctcccccggattttcaagggccagcgagagctcaccggacgccgccggaaccgcgacgctttccaaggcacgggcccctctctcggggcgaacccattccagggcgccctgcccttcacaaagaaaagagaactctccccggggctcccgccggcttctccgggatcggtcgcgttaccgcactggacgcctcgcggcgcccatctccgccactccggattcggagatctgaacccgactccctttcgatcggccgagcctctgtcaagtcttggaccaagtaaaaat

SEQ ID NO: 4310 - DNA, 1496 bp, Rattus norvegicus
  Genbank Accession No. NM_147138
  misc_feature (1)..(1496): n = a or c or g or t
accatggcggacgcggagaaaaacgctgttgcggagaaaaacgctgttgcggaggaaaacgccgttgcggaggaaaacgccgttgcggataaaaacgcaacgaaagaggttctggctgaggcagcaagcgttctggaacctgtaggattgccggaagaagcagagctgcctgccaagatcatggaggaatttatgaggaactctcggaagaaagacaagctgctctgtagccagcttcaagtagtgaacttcttacagacttttctggcccaggaggataatactgaccagaacccagatgctctggcttctgaagatacaagtcgacaaaaggcaactgaaactaaggagcagtggaaggagctgaaggcaacatacatggatcatgtggacgtcatcaaatgtgccctgtctgaggccttgccccaggttaaagaggcacacaggaagtacaccgagcttcagaaggcttttgagcaactcgaggctaagaagcgagtccttgaggagaaactgcagttagctcagaagcagtgggtgctgcagcagaagcgtttgcagaatctgacaaagatttctgctgaggtcaagagacgccggaagagagctctggagaagcttgatggttctcaccaggaacttgaaaccttgaagcagcaagcaggacaggagcaggagaagctgcagaggaaccagagctacctccagctgctgtgctccctgcagaataagctggtcatctctgagtccaaggccgacgacaaagatgtcaaagggcccgcccttccacccaagtctccgtaaagatgaaagcgagaagagagctgcgctccagctgtgctgcttgggctgagaccagagtggttccttcgctgttgtatccctaggcctangcctgtagccttgtacaatcttccaagcggactcaggtttggcatctcttggcttctcagtgaattgttctgtttcatttcttaccatatattctggcttgttctgtcttcacctgggtccaacttgctgtttctgtaaaattgtgccagtgaaattgtcacgtgcatgcacgcaggcacacaggcacgcatgccacaaccacccttttctctcgctgatcttcagtagtctctcctctggccctctctctctctgtcttctctcccgaccagatgtgaaagtaactttatgcacccgatgtaattgttgcctcggaggctcattgatgaataagctcaccctgtgtagttcttgctaaactctggctggctggttcaactcagctcttctggttcaaacccgtctccaaactgactgattgaaacaggcctctcttggcttggaaagtctgctctgaactccagaactgaacggtactgactgcactgactcgactgaacgcaactgcaccgagttgattgactccttctccctttactgctcttaagtaccctctcttccctgtgctgtcctcctgagtcatgctgccaaatcctcgtgcc

SEQ ID NO: 4311 - DNA, 1587 bp, Rattus norvegicus
  Genbank Accession No. NM_147177
cgcaggttgtggctgcacacactcgtcaaaatgaagattgaggaggtgaagagcaccacgaagacgcaacgcattgcctcccacagccacgtgaaggggctggggctggatgagagcggcctggccaagcaggcggcttcggggctcgtgggccaggagaacgcgagagaggcatgtggtgtcatagtcgaattaatcaaaagcaagaaaatggctggaagagctgtcttgttggcagggcctcctggaactggcaagacagccttggccctggctattgctcaggaactgggcagtaaagtccctttctgcccgatggtgggtagtgaagtatactcaactgagatcaagaagacagaggtgctgatggagaacttccgaagggctattgggctgcggataaaggagactaaggaggtttatgaaggggaggtgacagagctcactccctgtgagacagagaaccccatgggtgggtatggcaaaactatcagccacgtgatcatagggctcaagactgccaaaggaaccaaacagctgaagctggaccccagtatttttgaaagtttgcagaaagaacgagtagaggctggagatgtgatttacattgaagcaaacagtggagctgtgaagaggcaaggcaggtgtgacacctatgccacagagtttgaccttgaggctgaagagtatgtccctttgccaaagggagatgtgcacaagaagaaggaaatcatacaggatgtgaccttgcacgacttggacgtggccaatgcgcggcctcagggtgggcaagatattctgtctatgatgggccagttgatgaagccaaaaaagacagagatcacagataaacttcgaggggagatcaacaaggtggtgaacaaatacattgaccagggcgttgcagagctggtccctggagtgctctttgttgacgaggtccacatgctggatatcgagtgctttacctacctgcaccgagccctggagtcctccatcgcccccattgtcatctttgcatccaaccgaggcaactgtgtcatcaggggcaccgaggacatcacttctccacacggcatcccgttggacctgctggaccgggtgatgatcatcaggaccatgctgtatacgccacaggagatgaagcagatcattaagatccgagcccagacggaaggcatcaacatcagtgaggaggccctaaaccacctcggggagattggcaccaagaccacgctgaggtattcagtgcagctgctgacccctgccaacctgctggccaagatcaacgggaaggacagcattgagaaggagcacgtggaggagatcagcgagctcttctatgacgccaagtcctccgccaagattctggccgaccagcaggacaagtacatgaagtaacgtagggtttggaggtgcacccagaggacagaccccacaccgaggacagggtcttgcgttgagcatgctttgcagtgttacagtttgtttgtaaattatcaaacctccaaggttgtttggaaggaaccctttcccacctagcttgtttttctaataaaactgaatcttattttgatgataaaaaaa

SEQ ID NO: 4312 - DNA, 2101 bp, Rattus norvegicus
  Genbank Accession No. NM_147206
agcagccttatatgtatcaagatgcattttattaagtcttcatgggtatctggggaagaataaattgtttgtttggcctgagcaccaattagtgtccacatctctgagaaagaacatggatctacaactatccgtgaaagcccaatgcatgggggcaacatcaattagtactcgtgccgaattcggcacgaggggagctcagcacgttcagccctgcaaagggcagtacacaaaattgagagtaaagctcgaagagagacttgtttaaagaaaacggcaatggatttgatcccaaacttttccatggaaacctggctgctcctggttatcagcctggtgctcctctacctatatggaactcattcacatggaatttttaaaaagttgggaattcctgggcccaaacctttgcctttcttggggacgattcttgcttacaggaagggcttctgggaatttgacaaatactgccataaaaaatatgggaaattatgggggttgtacgatggtcgacagcctgtgctagcgatcacggatccagacataatcaaaacagtgctggtgaaggaatgttactctaccttcacaaaccgacggaactttggtccagtgggtattttgaaaaaagccatctccatctctgaggatgaagaatggaagagaattcgagccctgctgtctccaaccttcaccagtgggaagctcaaggagatgttccccatcattaaccagtatacagatatgttggtgagaaacatgaggcagggatcggaggaaggcaagcccaccagcatgaaagacatctttggggcctacagcatggatgtgatcacagccacctcatttggagtgaatgttgattcccttaacaacccacaggacccttttgtggaaaaagtcaagaagctcttaaaatttgatatctttgatccattgttcctctcagtgacactttttccattccttaccccactatttgaagcactaaatgtctccatgtttccaagagatgtcattgacttttttaaaacttcagtagaacgaatgaaagagaatcgcatgaaagagaaagaaaagcaaagaatggactttcttcagctgatgataaactcccagaattccaaagtcaaagactctcataaagcattatccgatgtggagattgtggcccagtcagttatcttcatttttgccggctatgagaccactagcagtgctctttcctttgttttgtatttgctggccattcaccctgatatacagaagaaactgcaggatgaaattgatgcagctctccccaataaggcacatgccacctatgataccctgctacaaatggagtatctagatatggtggtgaatgaaaccctcagattatatccaattgctggaaggcttgagagggtctgtaagacagatgttgaaatcaatggggtgttcattcccaaagggactgtggtgatgataccaacctttgctcttcacaaagacccgcattactggccagagcctgaggaattccgccctgaaaggttcagcaagaagaatcaggataacatcaatccttatatgtacctgccctttgggaatggacccaggaactgtattggcatgaggtttgctctcatgaacatgaaagttgctcttgtcagagtcctgcagaacttctccttccaaccttgtaaggaaactcagatccctttaaaattgagcaaacaaggacttcttcaaccagaaaagccactgcttctaaaagttgtgtccagagatgagactgtgaatggagcttgatgtagaatggcctatagtggtgttgtatcacatggaccagaaaccagttcatattgtgaatgaatccagagatgaagattgcagtaattttgttcactcctgggggttttgggtgttctttgagctttctcagcctctgtgcaagttgttttctgtggaacataaggatctaatgacataaatccaagataaatatattcaactcgtggttcttgtgggatggcctatgttaccttcattgttaccaccaaatactctgatttctgatgagaaaataaataaacatcaattactagttctatcaccatta

SEQ ID NO: 4313 - DNA, 878 bp, Rattus norvegicus
  Genbank Accession No. NM_147214
ggcacgagcagagagattgtcccaacagagaggcaattctattccctaccaacatgaagctgttgctgctgctgctgtgtctgggcctgacactggtctgtggccatgcagaagaagctagttccacaagagggaacctcgatgtggctaagctcaatggggattggttttctattgtcgtggcctctaacaaaagagaaaagatagaagagaatggcagcatgagagtttttatgcagcacatcgatgtcttggagaattccttaggcttcaagttccgtattaaggaaaatggagagtgcagggaactatatttggttgcctacaaaacgccagaggatggcgaatattttgttgagtatgacggagggaatacatttactatacttaagacagactatgacagatatgtcatgtttcatctcattaatttcaagaacggggaaaccttccagctgatggtgctctacggcagaacaaaggatctgagttcagacatcaaggaaaagtttgcaaaactatgtgaggcgcatggaatcactagggacaatatcattgatctaaccaagactgatcgctgtctccaggcccgaggatgaagaaaggcctgagcctccagtgctgagtggagacttctcaccaggactctagcatcaccatttcctgtccatggagcatcctgagacaaattctgcgatctgatttccatcctctgtcacagaaaagtgcaatcctggtctctccagcatcttccctaggttacccaggacaacacatcgagaattaaaagctttcttaaatttctcttggccccacccatgatcattccgcacaaatatcttgctcttgcagttcaataaatgattacccttgcactt

SEQ ID NO: 4314 - DNA, 1491 bp, Rattus norvegicus
  Genbank Accession No. NM_148891
atggcggatgagagtgagacagcagtgaagctgccggcaccttcgctgccactgatgatggaagggaatggaaacggccatgagcactgcagcgattgcgagaacgaggaggacatcagccacaacaggggtggcttgagtccagccaatgacactggagccaaaaagaagaaaaagaaacaaaagaagaagaaagagaaaggcaacgacatggattccacccaggatcagcctgtgaagatgaactctttgccagcagagaggatccaggaaatacagaaagccattgagctgttctcagtgggtcaggggcccgccaaaaccatggaggaagccagtaaacgaagctaccagttctgggatacacagccagtgcccaaattaggtgaagtggtaaacacccatggccctgtggaacctgacaaagacaacattcgccaggagccctacaccctaccccagggcttcacttgggatgccttggacctgggagaccgtggtgtgctaaaagaactgtacaccctcctgaacgagaactatgtggaagatgacgataacatgttccgattcgattattccccagagtttctcttgtgggctctccggccaccaggctggctcccacagtggcactgcggggtccgagtggtctcaagtcggaaactggttggattcatcagtgccatcccagcaaacatccacatctatgacacagagaagaagatggtggagatcaacttcctgtgtgtccacaagaagctacgctccaagcgggtggctccagtcttgatccgagagataacccggcgggtccacctggagggcattttccaagctgtttacactgccggcgtagtgttgccaaagcctgttggcacctgcaggtactggcatcggtccctgaaccctcggaagctgattgaagtcaagttctcccacctgagcagaaacatgaccatgcagcgcaccatgaagctgtaccggctgccagagactcccaagacagctgggctacgcccgatggaaaagaaggacattccggtagtgcaccagctgctcagcaggtacctgaagcagtttaacctcacccccgtcatgaaccaggaggaggtagagcactggttctacccccaggagaacatcattgacacttttgtggtagagaatgccaatggtgaggtgactgatttcctgagcttttatacacttccttccaccatcatgaaccatccaacccacaagagtctgaaagctgcatactccttctacaacgtccacacccagacccctcttctagacctcatgagcgacgccctcgttctagccaaaatgaaagggttcgacgtattcaatgcactggatctcatggagaacaaaacattcctggagaagctcaagttcggcataggggacggcaacctgcagtattacctgtacaattggaagtgcccgagcatgggggccgagaaggttgggttggtgttacagtaa

SEQ ID NO: 4315 - DNA, 976 bp, Rattus norvegicus
  Genbank Accession No. NM_152935
gtctggactgcagacaggcggcacggagagaccggcgagctccgatcggtcggagctaaccgctgccaggcggctgccgcggccccgcacacgccccagtcgagcgaagatggtgggccggaacagcgccatcgccgcggggctgtgcggtgccctcttcatagggtactgcatctactttgaccgcaaaaggcgaggtgaccccaacttcaagaacaggcttcgagaacgaagaaagaaacagaagcttgctaaggagagagctgggctttccaagttacctgatttaaaagatgctgaagctgttcagaaattcttccttgaagagatacagcttggtgaagagttattagcacaaggtgactatgagaagggtgtggaccacctgacaaatgcaatcgctgtgtgtggacagcctcagcagttgctgcaagtgttacaacagactcttccaccaccagtgttccagatgcttctgaccaagcttccaaccattagtcagagaattgtcagtgctcagagcttggctgaggatgatgtggaatgagccagacaccaacatgataaatctcagtaaaatgataacagttagctgcaggctgctctgctcggggggataagggcaaactgtgcttgtcatgaactgtctcacactgacatctccaaagtgaacctgaactttggtagagccattgtctgttctatttatttttccagtgagaagtattttgatagcttttcattttataaatacactgcgttaaccaaaagatcatggatttcgtttgttcttgacatgcagttcaatgtaaatacagtagtattaggtagagactcctggtgattttaaaggattgaaaagctgaggaatagttgaataatgcacattttaaagactagaacattttattgtcgttgtaaaattgagtagaaacttgtgtttgtgaaaactgagcattaaaaccttacagagaca

SEQ ID NO: 4316 - DNA, 379 bp, Rattus norvegicus
  Genbank Accession No. NM_152936
tcagtttctgaagagaagcaccctgcacagttcttctgagttttggacctaggtctacaaccatgaaggtagcaattatctttcttctcagtgctttggccctgctcaatttagcaggtaacactacagctaaggtgattgggaaaaaggctaattgccctaatacacttattggatgccccagggattatgatcctgtgtgtggtactgacggaaaaacttacgccaatgaatgcattctatgctttgaaaacaggaaatttggaacatctatccgcattcagaggagagggctttgctgaatgtcctgatttcgaaatcttttagggctaccataatgtttagcaagaaggtttgctgaataaatgcatctgaacat

SEQ ID NO: 4317 - DNA, 1778 bp, Rattus norvegicus
  Genbank Accession No. NM_153306
gggtggacagagcctgcggggggctgcgcctggctcccgcgcggggcaccatggacgacgccggcagctccggaggcagcggaggcttccgccccggagtagacagtctggatgagccgcccaacagccgcatcttcctagtgatcagcaagtacacatcggaatcggtgctgagggagcacttctcgcccttcggagacatccaggacatctgggtagtgcgcgacaagcacactaaggagtccaagggcatcgccttcgtcaagttcgcacgcagctcacaggcctgccgggctatggaggagatgcacggacagtgccttggtcccaacgacaccaagcccatcaaggttttcattgcccagtcccgatcatcagggagtcacagggatgtcgaagacgaagagctcacgaggatctttgtcatgataccaaagtcctacacggaggaagacctgcgggagaagttcaaggtgtatggagacatcgagtactgcagcgttattaagaataaagtcactggagaaagtaaaggcttgggctacgtgcggtacttaaaaccatcacaagctgcccaggcaatagaaaactgtgatagaagtttcagagcactcttggctgaacctaaaaataaagtgttggagtccccagaacaagattattacagtagcgtgaggcaggagactttggggcacgagcctagaggaaatctgtttcccttcgttggagaacaacaatctgaattttcaacttttgacaagaacgatagcagaggccaggaagctatctccaaacgcctgtcggtggcgtcgagggtccccttcacagaggagcagctcttcagcatttttgacatcgtcccagggctggagtactgtgaggttcaccgagacccttacttaaattatggtcatggcgtggttcagtattttaacgtggcatcggctgtttatgcacaatacaaactgcatggattccagtaccctcccgggaatcggatagctgtttcctttctggatgacggaagtaattcagctgatctcatcaggaaaatggccacacagatggtggcggcacagctcgcgtcaacggtgtggagtaacccgagtcaccagcagtttctgcaattcggaggaagtgctgggtcacaagtgcctcaaatccagacagacgtagtacttccgtcatgcagaaagaaagccccaccggaaactcctgtgaaagaaaggctgtttattgtgtttaatccccatcctttgccgttagacgtgttggaggatatattctgccgttttgggaacctgattgaggtctaccttgtgtcggggaaaaatgtgggctatgtcaagtatgctgatagaatgagcgccaatgacgccatcacaactctgcacgggaagattctaaatggggtcagacttaaggttatgctggcagattccccaagagaagtatccaaaaagaggcagagaacttactgagttttaaggacaaagactaactaatgacataatcctcagctgactgactgaaaacctgactggacgaacccctgtggacagttgacagctttttttttcttttcctcacatatttgatagtttacacaccattgcctatctgggatcgctgacatgtatttttatctgaccttaatggtaaaattaatatagtagttgtttcctagaacaaaatgttgctgtgtatagcagaaataaagcttccttagagaaatatgttgtcatgtatagcagaaataaagtttgctttgtataact

SEQ ID NO: 4318 - DNA, 1742 bp, Rattus norvegicus
  Genbank Accession No. NM_153308
gaattcggcaggcgcaggccaagcaactcggccgtccagcgggtgcaggtgcggaccaccatcaccgcgcgcgcttgcagccaccgtagacaccggtctctggctccctagagcggggcagccacagaacccgaggccatgtaccatgaaaagagtttcttggtctctggggacagctatcctcccccaaaccctggctatcctgtggggccacaagcccctatgcctccctatgttcagcctccctaccctggggccccatacccacaggccgctttccagccctctccctatggtcaaccagggtatccccatggtcccggtccctatcacaaggtggttacccctcaaggacctactcaaggaggctacccaccagggccattacccacagagccccttcccccctaacccctatggacagccaccacccttccaggaccctggctcacctcagcatgggaactaccaggaggaagggcctccatcctactatgacaaccaggacttcccctcggtcaactgggacaagagcattcgccaggccttcatccgaaaggtgttcctggtgctgaccctgcagctgtcggtaaccctgtcgactgtggccattttcacttttgtcggggaggtgaagggctttgtccgggccaatgtctggacctactatgtctcctacgccatcttcttcatctccctcattgtcctcagctgttgcggggacttccggaaaaagcatccctggaaccttgttgccctgtcgatcctgaccatcagtttgtcctacatggtgggcatgatagccagtttttacaacacggaggcggtcatcatggccgtgggcatcaccacagctgtctgcttcacggtggtcatcttctccatgcagacccgctacgacttcacctcgtgcatgggcgtgctcctggtgagcgtggtggtgctcttcatcttcgccatactctgcatcttcatccggaaccgcatcctggagatcgtgtacgcctcgctgggcgctctgctcttcacctgcttcctggctgtggacacccagctgctcctggggaacaagcaactgtccctgagcccagaagaatatgtgtttgcggccctgaatctgtacacggacatcatcaacatcttcctatacattctcaccatcattggccgtagccaaggaataggacaagccccagctcaggtggcatggtgggctcagacccatgcccctgccatgacattgccatctgtgcttccccctctctggttcccagccatggcctggagcagagggagcccctctcgccctcgtgtatgtacactgcaaatacttaacgttcggaccctctctgccacagcatggaaacctttatcccttttgcccttgccaaggggtgacagggctgcatttctgtgccaccttctgtctactcattgttgcatgagccctgtctgccagcccatcccggggtctgggatcaacaccaggtcccaggggagaaggatcataccaagaggtgagggtgcacgtcttccctcctgtcccagctcccctggcatagagtccccatgtcccctcctcaccctgccttctgaggggcttgcagggtggggcctcgttcttgttctgggccccgagaccaagagagggtggcatgtttcaggggagaggctctcttgtgtgctgccattgtaaaatgccaataaaagggtatcttctgctaaaaaaaaaaaccgaattc

SEQ ID NO: 4319 - DNA, 1936 bp, Rattus norvegicus
  Genbank Accession No. NM_153312
ctgcagagtatcagaggcccagctagagggagaacaccgaggagtaatttgctgacagacaagcagggatggacctgctttcagctctcacactggaaacctgggtcctcctggcagtcatcctggtgcttctctaccgacttggaacccatagacatggaatttttaagaaacaaggaattcctgggccaaaacctctgccttttttaggcactgtgctgaattactacaagggcttagggagatttgacatggagtgctataaaaagtatggaaaaatatgggggttgtttgatggtcaaacgcctgtgtttgccatcatggacacagagatgattaagaatgtactagtgaaggaatgcttttctgtcttcacaaaccggcgggattttggcccagtggggattatggggaaagctgtctctgtagctaaggatgaggagtggaagagatatagagccttgctgtcccccacgttcaccagtggaagactcaaggagatgttccccatcattgaacagtatggagacattttggtaaagtacttgaagcaagaggcggagacaggcaagcctgtcaccatgaaaaaagtgtttggtgcctacagcatggatgtgatcaccagcacatcatttggagtgaacgtcgattcccttaacaacccaaaggatccttttgtggagaaaaccaagaaattgttaagatttgacttttttgatccgttgttcttgtcagtagtactctttccattcctcaccccaatatatgagatgctaaatatctgcatgttcccaaaggattcaatagcatttttccaaaaatttgtgcacagaataaaggaaacccgtctggattctaagcataagcaccgagtggattttctccagctgatgctgaacgctcataataattccaaagacgaagtgtctcataaagccctgtctgatgttgaaatcatagcccagtcagttatctttatttttgctggctatgaaaccaccagcagcacactctcctttgtcttgtatttcctggccactcaccctgatattcagaagaaactgcaggaggagatcgatggggccctgccgagtaaggcacctcctacctacgatattgtgatggaaatggaatacctggatatggtgttgaatgaaactctcagattgtatccaattggtaatagacttgagagagtctgtaaaaaagatatagaacttgatggtttgtttatacccaaagggtcagtagtgacgattccaacatatgctcttcatcatgacccacagcactggccaaagcctgaggaatttcatccagaaaggtttagcaaggagaacaagggaagcattgatccttatgtatatctgccctttggaaatggacccaggaactgcattggcatgaggtttgctctcatgaatatgaaactcgctctcactaaagttctgcaaaacttctccttccagccttgcaaggaaacacagatacctctgaaattgagtagacaagcaattcttgaaccagaaaaacccattgttctaaaggttctgccacgggatgcagtcataaatggagcctgactttccctcaaggaattttattgggatcttcacaaaggcagtgtctaagaacattgaaccttttaatttacttcatgaatgaattccagataaaactgggacttaattgactgctcttgatgcatggttaaagatttggtacatttatggatctttctaagtgtctatacgaagtaccacataataaaaaggagttggcaagtctgtgatggaacaggaaattcacctttgctgattctcatgggaccatctccatccacatctggtggtctctgttaatttcttttgagctcttttgatagtaaccatgtctctgtaatttgatcaataatactttgatgtaaaggtgaaaa

SEQ ID NO: 4320 - DNA, 1630 bp, Rattus norvegicus
  Genbank Accession No. NM_153313
gttaagtgttggtcatttgtctttgggagcctgggcagcagcaaggcagccatggagctgctgaatgggactggcctgtggtccatggccatattcacagtcatcttcatattactggtggacctgatgcaccggcgccatcgctggacttctcgctaccctccaggccctgtgccgtggcctgtgctgggcaacctgctgcaggtggacctcagtaacatgccatacagcctctacaagcttcaacaccgctatggtgacgtgttcagcctgcagaagggttggaagcccatggtcattgtcaacagactgaaagcggtgcaggaagtgctggtgactcatggagaggacactgctgaccgccctccagtgcccatctttaagtgcctgggtgtgaagcccagatcccaaggtgtgatccttgcatcttacgggcctgagtggcgagagcagaggcgattctctgtgtccaccctgcgcaccttcggcatgggcaagaaatccctggaggagtgggtgaccaaggaggccggccacctctgtgatgccttcactgcccaggctgggcagtccatcaatcccaaggccatgctgaacaaagccttgtgtaatgtgatcgcatccctcatttttgcccgtcgctttgaatatgaagacccttacctcatcaggatggtgaaactagtggaagagagtttgacagaagtctctggtttcattcctgaggttcttaacacgttcccagcactgctgcgcatcccagggctggctgacaaggtcttccaaggtcagaagaccttcatggccttactggataacctgctggctgagaacaggaccacctgggaccctgcccagccaccccgaaatctgactgatgccttcctggctgaggtggagaaggccaaggggaatcctgagagcagctttaatgatgagaacctacgcatggtggtagttgacctgttcactgcagggatggtgaccaccgccaccacactgacctgggccctactgctcatgattctatacccggatgtgcagcgcagagtccaacaagagattgatgaggtcatagggcaggtgcggtgtccagagatgacagaccaggcccacatgccctacaccaatgctgtcatccatgaggtacagcgctttggggacattgctccattgaatttgccacgcatcacgagttgtgacattgaagtgcaggacttcgtcatccccaaggggacgaccctcatcatcaacctgtcgtccgtgctgaaggatgagaccgtctgggagaagccccaccgcttccatccagaacacttcctggatgcccagggcaactttgtgaagcatgaggccttcatgccattctcagcaggccgcagagcatgccttggggagcccctggcccgcatggagctcttcctcttcttcacctgcctcctgcagcgcttcagcttctccgtgcccgtcggacagccccggcccagcacccatggcttctttgcttttccagttgcccccttgccctaccagctctgtgctgtggtacgggagcaaggactctaattccagtccagctctacagggcaagctgagccacgtttaataaaccagtcttttggcgcgccta

SEQ ID NO: 4321 - DNA, 1716 bp, Rattus norvegicus
  Genbank Accession No. NM_153314
gaaagcttactagataaaaggtcaagcagtgacagaaaggaacacactgtgaacagaaggtttttgatttttaagatgcctgggaagtggatttctgctcttctgctgctacagataagttgctgtttccaatctgggaactgtgggaaggtgttggtgtggccgatggaattcagccactggatgaatataaaaacaatactggatgaacttgtacagaggggccatgaagtcagtgttctgaaaccttcggcttactatgttcttgatccgaaaaaatcgccagatcttaagtttgaaactttccctacatctgtcagtaaagatgaactggaaaattatttcataaagcttgtggatgtgtggacttatgagttgcaaagagatacatgtttgtcttattctcctttactacaaaatatgatagatgaattttctgattactatctaagtctttgtaaagacaccgtttcaaacaagcagctcatggcaaaactacaggaatccaagtttgatgttcttttgtcagatcctgtggctgcctgtggggagctgatagccgaagtgctccacattccttttctgtacagtcttcgcttctctccaggctacaaaattgaaaagtccagtggaagatttatattacctccatcttatgtaccagtaattttgtcaggaatgggtggcccaatgacattcatagacagggtaaaaaatatgatatgtacgctttattttgacttttggttccatatgtttaatgccaagaaatgggatccattttacagtgagatttttggaaggcccaccacattagctgagacaatgggcaaagcagaaatgtggctcattagatcctactgggatttggaatttccccacccaacattaccaaatgttgactatattggaggactccaatgcagacctcctaaacccttgcccaaggatatggaagattttgtccagagctctggagagcatggcgtggtggtgttttctctggggtcaatggtcagcagcatgacagaagaaaaggccaatgcaattgcatgggcccttgcccagattccacaaaaggttctttggaaatttgatggcaaaaccccagcaaccttaggacccaataccagagtctacaagtggcttccccagaatgacctccttggtcatccaaaaaccaaagcctttgtaactcatggtggagccaatggtgtctatgaggccatctatcatggaatccctatggttggcattcctatgtttggagaacaacatgataacattgcccacatggtggccaaaggagcagctgttacactgaatatcaggacaatgtcaaagacagatttgttcaatgcactaaaggaaataataaacaatccattctataaaaaaaatgctgtgtggttgtcaaccattcaccatgaccaacctatgaagcccctggacaaggctgtcttctggattgagtttgtcatgcgccacaaaggggccaagcacctgagaccacttggacatgaccttccctggtaccagtaccactctctggatgtgattggattcctgctctcctgttcggcagtcattgcagtccttactgtaaaatgcttcttgtttatttaccgactctttgtgaagaaggaaaagaaaatgaagaatgagtagagctcatttacaatgcactacaggaatgaaatttcagccacattctaa

SEQ ID NO: 4322 - DNA, 6779 bp, Rattus norvegicus
  Genbank Accession No. NM_153630
cgggcgcgctgcggttacagactgtggttttgtacctgcctcccacagctaacttcaccatgctcaaaagaaagcagagttccagggtggaagcccagccagtaactgactttggtcctgacgaatctctgtcagacaatgctgacatactctggattaataagccatgggtgcactctctgctgcgcatctgtgccatcatcagcgtcatctcagtgtgcatgaacacacctatgaccttcgagcactatcctccccttcagtatgtgaccttcaccctggacactttactgatgtttctctacactgcagagatgatagcaaagatgcacatacggggaattgtcaagggcgatagctcctatgtgaaggaccgctggtgtgtttttgatggattcatggtcttttgcctttgggtttctctcgtgttacaggtgtttgaaatagctgacatagttgatcagatgtcaccttggggcatgctgcggatcccacggccactcattatgatccgggctttcaggatttatttccgattcgaactgccaaggacccgaattacaaacattttaaagcggtcaggagaacaaatatggagtgtctcaatcttcctcctcttcttccttcttctgtatgggattttaggagttcagatgtttggaacatttacctaccactgcgtagtcaatgacacaaagccagggaatgtaacctggaatagcttagctatcccagatacgcactgctcgccagagctagaagaaggctatcagtgccccccaggatttaaatgcatggacctggaagacctgggacttagcaggcaagagctgggctacagtggctttaatgagataggcacgagtatattcacagtctatgaggcttcatctcaggaaggctgggtattcctcatgtacagagcaatcgacagtttcccccgttggcgttcctacttctacttcatcacgctgattttcttccttgcctggcttgtcaagaatgtgttcattgctgtcatcattgagacatttgcagaaatcagagtacaatttcaacaaatgtggggaactcggagcagcacaacttccactgccaccacgcagatgttccatgaagatgctgccggtggctggcagctggtagctgtggatgtcaacaagccccagggacgtgccccagcctgcctacagaaaatgatgcggtcatcagttttccacatgtttatcctgagcatggtgactgtggatgtaatagttgctgccagcaactactacaagggagagaacttcagaaggcagtatgacgagttctaccttgcagaggtggcttttacagttctttttgatctggaagcacttctgaagatatggtgtttggggtttactggctacatcagctcatctctccacaagtttgaactacttctggttattgggacaactctccatgtataccctgatctttatcattctcaatttacctacttccaggttcttcgggtagtccggcttattaagatttccccagcattggaagattttgtgtacaagatatttggtcccgggaaaaaacttggaagcttggtggtgttcactgccagtctcctgatagttatgtccgccatcagtttgcagatgttctgcttcgtcgaagaactggacagattcaccacatttccaagggcatttatgtccatgttccagatcctcacccaggaaggatgggtggatgtgatggatcagactctgaatgctgtggggcatatgtgggctccactggttgccatctatttcatcctctaccatctctttgcaacgctgatcctcctgagtttgtttgttgctgttattttggacaacttagaacttgatgaagatctaaagaagctcaaacaattaaaacaaagtgaagcgaacgcagataccaaagaaaaacttcctttgcgcttgagaatcttcgaaaaattcccaaacagaccgcaaatggtgaaaatctcaaaacttccttcagattttacagttcctaagatcagggaaagcttcatgaagcagttcattgaccgccagcaacaggacacctgctgtctcttcagaattctcccctctacctcttcctcatcctgtgacaaccccaagcggcccacagttgaagacaacaaatacattgatcaaaaactccgcaagtctgttttcagcataagggcaaggaaccttctggaaaaggagaccgcagtcacaaaaatcttaagagcttgcactcgacagcgcatgctgagcggatcattcgaggggcagccagcaaaggagaggtcgatcctcagcgtgcagcatcacatccgccaggagcgcaggtcactcagacatggatccaacagccagaggatcagcaggggcaaatctcttgaaacgttaactcaagatcattccaatacggtgcgctacagaaatgcacaaagagaagacagtgaaataaagatgatccaggagaagaaggagcaagcagagatgaaaaggaaggtgcaagaagaggagctgcgagagaaccacccatactttgacaagcctctcttcatcgtgggtcgagaacacaggttcagaaacttctgccgcgtggtggttcgagcacgcttcaatgcatccaaaacagaccctgtcacgggagctgtgaaaaatacaaagtaccaccaactttatgatttgctgggacttgtcacctacctggactgggtcatgatcactgtaaccatctgctcttgcatttctatgatgttcgaatcccccttccggagagtcatgcatgcacccactttacagatcgctgaatatgtgtttgtgatattcatgagcattgagcttaatctgaagattatggcagatggcttgtttttcactccaactgctgtcatcagggactttggtggcgtcatggacatatttatctatcttgtgagcttgatatttctttgttggatgcctcaaaatgtgcctgctgagtcaggagcccagctcctgatggttcttcggtgcctaagacctcttcggatattcaaactggtgccacaaatgaggaaagttgttcgagaacttttcagtggtttcaaggaaatatttttggtctccattctgttgctgacactaatgcttgtttttgcaagctttggtgttcagctctttgccggaaagctagccaagtgcaatgaccccaacattatcagaagggaagactgtaacggcatcttcagaattaatgtaagtgtgtccaagaacttaaatttaaaactaagacctggagagaaaaaacctggattttgggtgccccgtgtttgggcaaatcctcgtaactttaactttgacaatgtgggaaatgctatgctggcattgtttgaagttctgtccttgaaaggctgggtagaagtgagagatgtcattattcatcgtgtggggccgatccatggaatctatattcatgttttcgtattcctgggttgcatgattggactgactctttttgtcggtgtagttattgctaacttcaatgaaaacaaggggacagccctgctgacggtagatcagagaagatgggaagatctcaagagcagattgaagatcgcacagcctcttcatctcccacctcggccggataatgatggatttagagctaaaatgtatgacataacccagcatccgttttttaaaaggacaattgcgttgctggttctggcccagtctgtgttgctatctgtcaagtgggatgttgaggatcctgtgacagttcctttggcaaccatgtcggtcgtgttcaccttcatctttgtcttagaggttacaatgaagatcatagcaatgtcaccagctggtttctggcaaagcagaagaaaccgatatgatctcttggtgacgtctcttggtgttgtgtgggtggtgctccattttgctctgctgaatgcatacacctacatgatgggagcctgtgtgattgtctttagatttttctccatctgtggaaagcatgtgacattaaagatgctccttttgactgtggttgtcagcatgtacaagagcttctttatcatcgtaggaatgtttctcttgctgctgtgctatgcctttgctggggtggttctgtttggcactgtaaagtatggagagaacattaacaggcatgccaatttttcttcagctggcaaagccattactgtattgttccgaattgtcacaggggaagactggaataagattatgcatgattgtatggttcagcctccattttgtactcctgatgaatttacatattgggcaacagactgtggcaattatgcaggggcacttatgtacttctgctcattctatgtcatcatcgcctacatcatgctgaatctacttgtagccataattgtggagaatttctctttgttttattccactgaagaggaccagcttttgagttacaatgatcttcgccattttcaaatcatatggaatatggtagatgataacgagaggtgtgatcccaccttccgagtgaagttcctgctacggctactgcgtgggaggctagaagtggaccttgataaagacaagctcctgtttaagcacatgtgctatgagatggagaggctgcacaatggtggtgatgtcaccttccatgatgtcttgagcatgctgtcctaccgctctgtagacatcaggaagagcctgcagctagaggaactgctggcaagggagcagctggagtacaccatagaggaggaggtggctaagcagactattcgcatgtggctgaagaagtgcttaaaacgcatccgggctaaacagcagcagtcatgcagcatcatccacagcctgagagagagccagcagcaagagttgagccgattcctgaatcctcccagcattgagaccacccaaccaagcgaagataccaacgccaacagccaggaccacaatacgcaacctgagtcaagcagtcagcagcagctcttgagccctactctgtcagacagaggaggaagtcgacaggatgcagcagatactgggaaaccccaaagaaagattgggcaatggcgtctgccctcagctcccaaaccaataagccattctgtgtcttcggttaacctacggtttggaggaaggacaacaatgaagtctgtggtgtgcaagatgaaccccatgccagacacagcttcctgtggctccgaagttaaaaagtggtggaccagacagctgactgtggagagtgacgagagtggagatgacctcctagatatctagaggggaagcaaagcatagggatttatcgggtgaaaaccactgcctaatctcttgttttatctctgagagagcaaactgtagttgccaaaccctaaatttcacccgagcatggcattttcagaattaacttttgttcatttattggaatggtccctcaaagagtatgaagtttcagattactctcatgtattaaagaaaatctggggcttgggatgtaagtcagtgaaagaccacttgtccaacctatgaaaacccgtgtgtttaaaacccagaaatacaagaaaagaaggaaaatatgtataatgcagtattgataatattagaagctgcatcaatagtagatgtgtattaaatattcatgtattctgtctgtgtaagataagctgtactcacctgcactcctgtattttgttactactcctctcaaagagtgctaagcccatactggcccatattgatagtacaggagttgtagctctagttcacctttttttcccatttccaatagaaatactttccttgggagaaattatttatgattgatctgaaaaggtcaatcatgctaaaatgacagcagcttcaaaactacagattctggatttttaaaaacattccttttctcatattatttaaaaaatatgcctgatgttaaaaaaattagacaatttgattttttatttcaagtactctaattgaactgtggcctgcttccaagaaagttatatatgtaggtcccatgtaaaggaactggctatagatataattggtatataacaaacctgtaggtatattattcatggacttgatgagacaaaaatattttgaaatctttaaaaaccctttaaataactgagtttataaaaaaagaataaaagtgttggagtcaacatagctaaaagtttacacttgagacttattgtggacttcatggcttatccttgctgtatccattttgctatgaatcagcaggaacattatgggttggctttaatacaccattactatgtagattgaaaataatttccctgcttccagaattatctattgaaataataacagaagggtgccaaaacttcactctaaaccccattgggaataccacaacataattatattttcccacacaccaatgctccaggttctctgggaaaagtggaaatataaaattattggaaagtattgatgggccctggctgggcagagtctcccctgagttgtcattatcaattgcatatttgatgatcagattattttaagagattgagtgtgtaaaaattccctgatgcctaggttgctttatgatatccttttgtctatttaaccttcttcaaatagccaaacattgtgtccttcctacacagaagatgtgatataatgtgcccatctactgcttttatgattacttgtgactattagataataggcaattcaagttcatgccgccaaggggcctttttattgggttttatgtttggtcagaatttgatttttggatataaaagccgg

SEQ ID NO: 4323 - DNA, 2319 bp, Rattus norvegicus
  Genbank Accession No. NM_153740
atggccacagaaatcgacttactgagagaccaaaatgttaaactaaatgatattcttaggcagcatcaaatcgaacatattttcagagacccagctatgcagaacagcatgtccaaaggaggcagaggtgacacactaacaaactctgtaaatgaccaaagtgctttacctcctctcattgctgagtatgagaaacatctcgaagagctaaacaggcagctgacctattaccagaaacacatgggtgagatgaaactacaacttgaaaccgtcatcacagaaaatgaaaggttacacagtaaattaaaagatgctgttgaaaagcaattggaagcccttccctttggcacagggataggaaatgacatctgtgcagatgatgagaccgtgaggaatcttcaagaacaattgcaaatagccaatcaagagaaaaattgggctgttcaactctggcagactgcgtctcaggagttagaaagtgttcagaaactctaccaggaacatatgactgaagcccagattcatgtatttgaaaaccggaaacaaaaagatcagctgaacaattttcaacaactaaccaagaaactccatgttgctaatgagaacattgaaatgactaaccaccacttcctgaaaacagtaactgaacaaaacatggagattgagaaacttcgaaaacaacttaggcaagccaagttagatctgagagttgcagtaacgaaagtggaagagttaactaaagtgactgaaggtcttcaagagcagatgctgaagaaggaggaagatattatgtctgcacaaggaaaagaggaagcatcagatagacgtgtgcagcagttacagtctagtataaaacagttagagtcaagattgtgtatagcaattcaagaagccaatgtactaaaaacagggaaaacacaattggaaaagcagatcaaagagctacaagcaaagtgcagtgaatcagaaaatgagaaatatgaggctatttcaagagccagagatagcatgcagctgttagaagaagctaacattaaacagaatcagattctacttgaagagaagcaaaaagaggttgaaagagaaaaaatgaagaaaacaatttctcatcttatacaagatgccgccatcaaagcaaggaaagaagttgaaagcacaaaaaaacagtatgaagtactaattttgcagttaaaggaagaactctcagcccttcagatggactgtgatgaaaagcaaggtcaaattgatcgagccattagagggaaaagagctgtggaagaagaactcgagaagatttatcgtgaaggcaaacaggatgaaggtgattacagaaaattggaagaaatgcaccaaagatgtcttgctgcagagcgttcaaaagatgatcttcagctaagactcaagactgcagaaaatagaataaaacaacttgaaattaattcctcagaagagatatcacgttcccatgaaatgatccagaaacttcaaactgtattggagtctgagagggagaactgtggctttgtcagcgagcaaaggctgaagcttcagcaagaaaatgagcaactacagaaggagactgaggatttgagaaaagttgctctggaggcccaaaaaaaagcaaaattaaaggtcagtacaatggagcatcagttctcaataaaggagcatgggtttgaagttcagctgagagagatggaggacagtaatcggaactccattgttgaactgaggcatcttttggcagctcaacaaaagacggccaataggtggaaagaagaaaccaagaaactgacggaaagtgcagaaatgaggatcagcagtctaaagagtgagctgagccgacagaagcttcatacccaggagctactttctcagctggaaatggcaaatgagaaggtagctgagaatgaaaagttaattctggaacatcaagaaaaagccaacagacttcaaaggcgtttaagtcaggcagaagagagagctgcttcagcgtcccagcagctcagtgtgattacagtgcagagaagaaaagcagcttccatgatgaatctggaaaatatttaaacatattcatagttcactgacagagctgtagagttgggaaagctgttgtaccaaccaaagcatcttgatatggagaaactgccgagagagaatggtgaaagcttgtgtcgtttgcataagcattttccattctgtttgcagggttattggaaaacagaacagtgacagcttcctgtaagtaaaaactataatcctatatttgagattcagtggagaataaagccagctgagaagaaaaaaaaaaaaaaaaaa

SEQ ID NO: 4324 - DNA, 556 bp, Rattus norvegicus
  Genbank Accession No. R46934
  misc_feature (1)..(556): n = a or c or g or t
ggnacgaggaaccatcaagaaatggggacctggatcttgtttgcctgcctcctgggagcagcttttgntatgcccctaccacctcatcctgggagccctggttatatcaacttaagctatgaggtgcttacccccttgaagtggtaccagagcatgataaggnagccgnatcccccgagtcacacccttcagtctcatcaccacctcccagtggtgccagttcaacagcccgtggccccccagcaaccaatgatgccagttcctggccacccactccatgaactccaacccaacaccatcagccaaacatccctccatccgnccagnaggccttccaggtaggccttccagncccaggtcattccaccccagtctnaatcaggcnatgtagncccagtcanctcttgtatcccatgaaggccccttggnaaccacaggccacntcttngcttcanttgttcttccaaggaggccccttgttcccccccatttcttcccctgagntttncntttttggaaggtttgggccagggaaaagaaaaagacccaagngggc

SEQ ID NO: 4325 - DNA, 376 bp, Rattus norvegicus
  Genbank Accession No. R47028
  misc_feature (1)..(376): n = a or c or g or t
ggcacgagcgctacaattacatttattattctacttctacttacagtacttgaatttgncgtagccttaattcaagcctatgtattcacccttctagtaagcctgtacctacatgataacacataatgacccaccagacccatgcataccatatagtaaacccaagcccatgaccactaacaggagncctatcagntcttctactcacatccggcttagnaatatgattccattacaactccacaatnctcctatcattagggctcctgacaaacatcctagctatatatcaatgatgacgagatatcatccggggaaggnacataccangggcaccacacccctattgtncagaaaggnctccgggtgcggaata

SEQ ID NO: 4326 - DNA, 477 bp, Rattus norvegicus
  Genbank Accession No. R47122
  misc_feature (1)..(477): n = a or c or g or t
ttcnggatttgttatacgactcactatagggcgagttgggtaccgggccccccctcgagttttttttttttttttttggaatgtaaatctttttnttaaaacacttgtctttccacagtagtaaagtgttggcatgtncatntaaaaatagtcaccanccataattatactgaatnccncttatcanctgcatacaaagtgtcttcaatacaatttctcccgtntaaaaatactgggaaaaattgataaataacaggtaagagaaagatatttctaggcaattagggattgttgggacagtgantcctgtggggtgtntggacacagccacaggacagggcctcctgacagtggctggaggntcaggcgggaagggggaaagnagaactgnctggtnttaaacttcctggctcccngctctcggggtacttaccattcaatttcaanggggaatcggngggttgggggtacccccgg

SEQ ID NO: 4327 - DNA, 2524 bp, Rattus norvegicus
  Genbank Accession No. S45392
ggcctaggcttgccgtgcgagtcggacgtggtccgggcccaccctgctctgtactactactcggctttctcgtcaagatgcctgaggaagtgcaccatggagaggaagaggtggagaccttcgcctttcaggcagaaattgcccagctgatgtccctcatcatcaacactttttactcaaacaaagagattttcctccgggagttgatctctaatgcttctgatgccctggacaagattcggtatgagagcctgactgacccttccaagttggacagcgggaaagagctgaagattgacatcatccccaaccctcaggaagccacgctgactttggtggacacaggcattggcatgaccaaggctgacctcataaataacttgggaaccattgctaagtctggtacaaaggcgttcatggaggctctccaggctggtgcagacatctccatgattgggcagtttggtgtcggcttctactctgcctacctggtggcagagaaagtggttgtgatcacgaagcacaacgatgatgagcagtatgcctgggagtcttctgctggtggatccttcactgtccgtgcagaccacggtgagcccattggccggggtaccaaagtgatccttcacctcaaagaagaccagacagagtacttagaggagaggagggtcaaggaggtggtgaagaaacactcacagttcataggctaccccatcaccctctatctggagaaggaacgcgagaaggagatcagtgatgatgaggcagaggaagagaaaggggagaaggaggaggaagataaggaggatgaggagaagcctaagattgaggatgtgggatctgatgaggaggatgacagcggcaaagataagaaaaagaaaacaaagaagatcaaggagaagtacattgaccaggaagagctgaataagacgaagcccatctggaccagaaatcctgatgacatcactcaagaggaatatggtgaattctacaagagcctcaccaatgactgggaagaccacttggcagtcaagcacttctctgtagaagggcagttggaattcagggcattgctcttcattccccggcgagctccctttgacctctttgagaacaagaagaagaagaacaacatcaaattgtatgtccgtcgtgtgttcatcatggacagctgtgatgacctgatacctgagtacctcaacttcatccgtggtgtggttgattccgaggacctgcctctgaacatctcccgagaaatgctccagcagagcaagatcctgaaagtcatccgcaaaaacattgtgaagaagtgccttgagctcttctctgagttggctgaagacaaagagaactacaagaaattttatgaggcattctctaagaatttaaagcttggaatccatgaggattccactaaccgtcgccgcctctctgagctccttcgctaccatacctctcagtctggagatgagatgacttccctgtcagagtatgtgtctcgcatgaaggagacacagaagtccatctactatatcactggtgagagcaaagagcaggtggccaactctgccttcgtggagcgtgtgcggaaacggggctttgaggtggtatacatgactgagcccattgatgagtactgcgtacagcagctcaaggagttcgatggcaagagcctggtctccgtgaccaaggagggcctggagctaccagaggatgaggaagagaagaaaaaaatggaggagagcaaggcaaggtttgagaatctctgcaagctcatgaaggagatcttggacaagaaggttgaaaaagtgactatctccaataggcttgtgtcttccccctgctgcattgtgaccagcacctacggctggacagccaacatggaacggattatgaaggcccaggcactgcgggacaactcgacaatgggctacatgatggccaagaaacacctagagatcaaccctgaccaccccattgtggagactctgcggcagaaggctgaggcagacaaaaacgacaaagctgtcaaagacctggtggtgctgctgtttgagactgctctgtcttctctcgcttctcactttaggaggcccaaaacccactccaaccgcatctaccgcatgattaaactaggcctgggcattgatgaagatgaggtcactgcagaagagcccagtgctgctgttcccgatgagatccccccactggagggtgatgaggatgcctctcgcatggaagaagtggattaaaggctcctgggaagcccccgccctctgtatagtatccctgtggctcccccaacagccttgactggccctgacccacctgggctctctctgctcatgtctacaagaatctcttctatcctgtccttgtgccttaaggcaggaagatcccctcccacagatagcagggttgggtgttgtgtattgtgtttttttgtttgttttattttgttctgaaattaaaagtatgcaaaataaagatgatgcagttttaaaaaaaaaaaaaaaaaaaaagg

SEQ ID NO: 4328 - DNA, 954 bp, Rattus norvegicus
  Genbank Accession No. S46798
ccggaatacctttcctcacaggattctattcaaaagatctcatcatcgaagccatcaacacgtgtaacaccaacgcctgagccctaataatcactttaatcgccacatccataactgctgtgtacagcatacgcatcatctacttcgtcaccatgacaaaaccacgatactccccactaattactattaatgaaaacaacccaaacctcattaatccaatcaaacgcctagcattaggaagcatcctagcaggcttccttatctcactaaatattcctccaactaacattcaaattctcacaataccctgacatttaaaaataacagccctacttattacaatcctaggatttgccattgccctagaacttaacaatttaacactaaatctatcaataagcaaacccaccaaactatcatcattctcaacctccctaggctactacccaccaattataccccgaattattcctcaaaaaactctaaattctagctacaaattatccttaaacctactagacctaatctgactagaaaagacaatcccaaaatcaacctcaatcacccaaacccaactatctaaaataatatccaaccaaaaaggactaatcaaactatatttcctatcatttctcatcactatttcactaatttttatcttacacacacttaatcccgagtgatttcaataataataaaaatccccgcaaacatagaccacccagccaccactatcattcaagtagcacaactataaatagccgcaaccccaatccccccctccaacataaccccaacatcatcaatctcatacattaatcaatcgcctagactatcaaaatcaactaactccaccttattattcaaactaaacaagtagaacactaccaactccataaaaagccctaaaacaaaaaaactaaaaataaaccaattagaccctcaagtttccgg

SEQ ID NO: 4329 - DNA, 2277 bp, Rattus norvegicus
  Genbank Accession No. S48190
  misc_feature (1)..(2277): n = a or c or g or t
gcacgagggcgcctcgggaaaatgggagctgctgcaaagttggcgttcgccgtctttcttatctcttgctcttcaggtgctatacttggcagatcggaaactcaggagtgtcttttctttaatgctaattgggaaagagacagaaccaatcagactggtgttgagccttgctatggtgataaagacaaacgacgacattgttttgctacctggaagaatatttctggttccattgaaatagtaaagcaaggttgttggctggatgatatcaactgctatgacaggactgattgtatagaaaaaaaagacagccctgaagtgtacttttgttgctgtgagggcaatatgtgtaatgaaaagttctcttattttccggagatggaagtcacacagcccacatcaaatcctgttaccccgaaaccaccctactacaacatcctgctgtattccttggtaccacttatgttaattgcggggattgtcatttgtgcgttttgggtgtacagacatcacaagatggcctaccctcctgtacttgttcctactcaggaccctggaccacctccaccttccccattactagggttgaagccattgcagctattggaagtgaaagcaaggggaagatttggttgtgtctggaaagcccagttgctcaatgagtatgtggctatcaaaatatttccgatacaggacaaacagtcctggcagaatgaatatgaagtctatagtttacctgggatgaagcatgaaaacatactacagttcattggtgcagagaaaagaggcaccagtgttgatgtggacctgtggctaatcacggcttttcatgaaaagggctcactgtcagactttcttaaggctaatgtggtctcttggaatgaactttgtcatattgcagaaaccatggctagaggattggcatatttacatgaggatatacctggcttaaaagatggccacaagcctgcaatatctcacagggacatcaaaagtaaaaatgtgctgttgaaaaacaatctgacagcttgcattgctgactttgggttggccttaaagtttgaggctggcaagtctgcaggtgacacccatggccaggttggtacccggaggtatatggctccagaggtgttagagggtgctataaacttccaaagggacgcatttctgaggatagatatgtacgccatgggattagtcctgtgggaactggcttctcgttgtactgctgcagatggacctgtagatgagtacatgttgccatttgaggaggaaattggccagcatccatctcttgaagatatgcaggaagttgttgtgcataaaaaaaagaggcccgttttaagagattattggcagaaacacgcaggaatggcaatgctctgtgaaacgatagaagaatgctgggatcatgatgcagaagccaggttatcagctggatgtgtaggtgaaagaattactcagatgcaaagactaacaaatataattactacagaggacattgtaacagtggtcacaatggtgacaaatgttgactttcctcccaaagaatctagtctatgatggttgcaccatctgtccacactgagaatcgggactctgaactggagctgctaagctaaggaaactgcttagtttattttctgtgtgaaatgagtagggtgcctccgggacacgtatgcaagcagccccttgtggaaagcatggattgggagacttcctgcagngtctgcaacacggatatgaagggggtctaaggggaaactgcgaactgtaaagaacttctgaaaacttacacgaagaatgtggccctctccaaatcaaggatcttttggacctggctaatcaagtatttgaaaactgacatcagatttcttaatgtctgtcagaagacactaattccttaaatgaactactgctattttttttaaatcaaaaacttttcatttcagattttaaaaagggtaactttttattgcatttgctgttgtttctataaatgactattgtaatgccaacatgacacagcttgtgaatgtgtagtgtgctgctgttctgtgtacatagtcatcaaagtggggtacagtaaagaggcttccaagcattactttaacctccctcaacaaggtatacctcagttccacggttgctaaattataaaattgaaaacactaacagaatttgaataaatcagtccatgttttataacaaggtattacaaactcactgtgttatttaagaaaaaatggtaagctatgcttagtgccaatagaagct

SEQ ID NO: 4330 - DNA, 749 bp, Rattus norvegicus
  Genbank Accession No. S58528
aagctggaagtttctgtatatagtgatcaaaagaagatctatattggggatgacaaccctctgaccctgaccgtgaaggcgcagaatcaaggagaaggcgcctatgaagctgagctcatcgtttctatcccaccgcaggctgacttcatcggggttgtccggaacaacgaagccttagcaagactgtcctgtgcatttaagacagaaaaccaaacccggcaggtggtgtgtgaccttgggaacccgaagaaggctggaactcaactgcttgctggccttcgtttcagcgtgcaccagcaatcagagatggatacttctgtgaagtttgacttgaaaatccaaagctctaattcttttgacaatgtcagcccagtcgtgtcttacaaggtcgaccttgccgttttggctgcagttgagataagaggagtttcaagccctgatcacatctttcttccaattccaaactgggagcacaaggaaagccctgagaccgaagaagacgttgggcctgttgttcagcacatctatgagctgagaaacaatggtccaagttcattcagcaaggcaatcctgaacctccagtggccttacaaatacaacaacaatactttgctgtacattctccattacgacattgatggaccaatgaactgcacttcagatatggagatcaaccctttgagaattaagatgcctgaaaagaatgacacgggagctgagcaaggaggaaggaatcatctcatcaccaa

SEQ ID NO: 4331 - DNA, 126 bp, Rattus norvegicus
  Genbank Accession No. S59892
gtgtttggatgattaaaatatgaaaaggaagattcttcctcttaattgcctttgtaatatgagaatgtattagtacagacttgtaaaatatatactgtataaaaattagccaatagttctttcttc

SEQ ID NO: 4332 - DNA, 106 bp, Rattus norvegicus
  Genbank Accession No. S59893
gtgtttggatgattaaaatatgaaaaggaagattcttcctcttaattgcctttgtaatatgagaatgtattagtacagacttgtaaaatatatactgtataaaaat

SEQ ID NO: 4333 - DNA, 1892 bp, Rattus norvegicus
  Genbank Accession No. S61960
aaactgaccaaggagtatgatcaatcccgtccagcctccgagcctgcagccgtttggtcatggtgagctgcttcagctaacaattgcactgacagtgctcttgagccaagttgcttctgggcggaagtagtccatctagggctcggcctctttaaagaaacagacttctgcaaccttgggactacgtttggggtcgccggctattggacggagcagcgcaattgttagctgaagcagctcaccatgaccaaacggctgcaggctcggaggctggacgggattgatcaaaacctctgggtggagtttggcaaactgaccaaggagtatgacgtcgtgaacttgggtcagggcttccctgacttctcgcctccggactttgcaacgcaagcttttcagcaggctaccagtgggaacttcatgctcaaccagtacaccagggcatttggttacccaccactgacaaacgtcctggcaagtttctttggcaagctgctgggacaggagatggacccactcacgaatgtgctggtgacagtgggtgcctatggggccttgttcacacgctttcaggccctggtggatgaaggagatgaggtcatcatcatggaacctgcttttgactgttatgaacccatgacaatgatggctggaggttgccctgtgttcgtgactctgaagccgagccctgctcctaaggggaaactgggagccagcaatgattggcaactggatcctgcagaactggccagcaagttcacacctcgcaccaagatcctggtcctcaacacacccaacaaccctttaggaaaggtattctctaggatggagctggagctggtggctaatctgtgccagcagcacgatgtcgtgtgcatctctgatgaggtctaccagtggctggtctatgacgggcaccagcacgtcagcatcgccagcctccctggcatgtgggatcggaccctgaccatcggcagtgcaggcaaaagcttcagtgccactggctggaaggtgggctgggtcatgggtccagataacatcatgaagcacctgaggacagtgcaccagaattctatcttccactgccccacccaggcccaggctgcagtagcccagtgctttgagcgggagcagcaacactttggacaacccagcagctactttttgcagctgccacaggccatggagctgaaccgagaccacatgatccgtagcctgcagtcagtgggcctcaagctctggatctcccaggggagctacttcctcattgcagacatctcagacttcaagagcaagatgcctgacctgcccggagctgaggatgagccttatgacagacgctttgccaagtggatgatcaaaaacatgggcttggtgggcatccctgtctccacattcttcagtcggccccatcagaaggactttgaccactacatccgattctgttttgtcaaggacaaggccacactccaggccatggatgagagactgcgcaagtggaaagagctccaaccctgaggaggctgccctcagccccacctcgaacacaggcctcagctatgccttagcacagggatggcactggagggcccagctgtgtgactgcgcatgtttccagaaaagaggccatgtcttgggggttgaagccatcctttcccagtgtccatctggactattgggttgggggccagttctgggtctcagcctactcctctgtaggttgcctgtagggttttgattgtttctggcctctctgcctggggcaggaaagggtggaatatcaggcccggtaccaccttagccctgccgaggctctgtggcttctctacatcttctcctgtgacctcaggatgttgctactgttcctaataaagttttaagttattaggaccctc

SEQ ID NO: 4334 - DNA, 1030 bp, Rattus norvegicus
  Genbank Accession No. S65091
gggcggaaggccgcactgttgccacaatgatttcctgttcttcctttttcaggttgtcgaccatgtgtcaagctgtgtagggaaactgcctggagatggacattctgactgctaatggggacatgggacggcagttacctctgatcacttgcgtggattctcctggagcagaaagacagaagccgccagtcactgctccggatctagcactgggattctgtgctgaagggtctaaaaactcgttttgatttggatctgggagaatgtctgagcaaggagaactaaccccgaccatactggaagaaggccggacagagccagaatctgccccagaaaatggcatcctcaagtcagaaagtctggatgaggaggagaagctggaactgcagcggcgactggcagctcagaaccaagagagaagaaaatccaagtcaggagcaggtaaagggaagctgaccagaagtcttgctgtctgtggaagagtcttcagccagacctggaggggaaagtcaccaggatcagactctctgagaactgcaaacggaaaggaactcaaaagaacttagattaaaacttaacttacaaatgataaaataaaataaaataataaaatccagtaagcacggaagtgctcgatgtccactgaggctctctcttgataaggctgaaccaaatacaccccaagcatcctgtctctatggagacagcttacctctcagctccccaaatgaacctgcctataaataacacaccactgttggctcctaggagatgagaaatagtgtctaagcaccctgaactgtggagaaatgctgctatggccttcgggaggttgttggtttttggtttggtttgtttttttttttttttttttttttaactactgcaaaaccggcccagaagagcgtctgaactggtagcgaatttgatattaaccagctgctgcacctccactctgtgatcccccaaagcttaaagttccagggcccttcgcatcctcttcgttacccttttttttttccttttttaa

SEQ ID NO: 4335 - DNA, 433 bp, Rattus norvegicus
  Genbank Accession No. S68809
accctcatccatgtgttccatgcccactcgggcaaggaaggggacaaatataagctgagcaagaaggagctgaaagacctgctacaaactgaactctccagcttcctggatgtccagaaggatgcagatgctgtggacaggatcatgaaggaactggatgagaatggagatggggaagtggacttccaggagtttgttgtgctggtggctgctctcacggtggcttgtaacaacttcttctgggagaacagttgagcacagtctcagtaggcagcgccctccctcttttgctcctcatcccacctgtatctccctatgtacccatccttgcccaggctcaacatgcaccaaaggcgcaacagtagcagtcctgccactagttttaataaagcttctctctcccgaaaaaaaaaaaaaaaaaaaaaaaaaaaaa

SEQ ID NO: 4336 - DNA, 3762 bp, Rattus norvegicus
  Genbank Accession No. S68944
gaattccacttctcagccttgcttgtttctcttaccaaggtgtttttcaggtcctcctggccttttcatgacataatttcattgatttcaatgatatacaatatttctttaagcttattttactattatggcatttttgactccagtttttaatttttttctggagctaagaactgaacacagggtcttgcacttgctaggccagcactttaccatgagctcgaaccctaacccctatatggcatctgagagtaaccatctccttcatcttcacagccaaagcttgtacggaccaaggcctggagcagcttcttaaatgtcgctatctatggatggcaatgttctcttcacatatgtgcctgttcagaatttcagatttagaaaaagaatgccaaatatttcacactcacttacatgtaggtatctagaaaacattcagagactttggaaaccaactgtccagcctcatgttgagcaagcatgatgtatataataaagaatttgggctggagagatggctcagcagttaagagcacccaactgctcttccagaggtcaagagttcaattcccagcaaccacatggtggcttacaaccatctgtaaagagatccgatgccctcttctggtgtatctgaagacagctacagtatacggagctgcggcgccggcgcacgcgggacaggcttttggatgagagaaagctgacaggagctgagccccaccttctctgtgtgctggggaatagggctacgcagccccagtggcacccatgccgaagaacagcaaggtgacccagcgtgaacacagcaatgagcatgtcactgagtcggtggctgacctgctggccctcgaggagcctgtggactataagcagagtgtactgaacgtggctggtgagacaggtggcaagcagaaggtggcggaggaggagctggacgcagaggaccggccagcctggaacagcaagctgcagtacatcctggcccagatcggcttttctgtgggccttggcaacatctggaggttcccctacctgtgccagaaaaatggaggaggtgcctacctggtgccctacctggtgctgctgatcattattggcatccccctcttctttctggagctggctgtgggccagaggatccgccgtggcagcattggggtctggcactatgtgtgcccccgcctggggggcattggcttttccagctgtattgtctgcctcttcgttgggctgtactacaacgtgatcattggatggagcgtcttctacttcttcaagtctttccagtacccactgccctggagtgaatgtcctgtcatcaggaatgggactgtggcagtggtggagcctgagtgcgagaagagctcagctactacctacttctggtatcgagaggccttggacatctccaactccatctcagagagtgggggcctcaactggaagatgacagtctgcctccttgtggcctggagcatcgtgggcatggctgtagtcaagggcatccagtcctctggaaaggtaatgtatttcagctccctcttcccctgtgtggtgttggcctgcttcctggtccggggactgctgcttcgaggggcagttgatggcatcctgcacatgttcactcctaagctggacaagatgctggacccccaggtgtggcgggaggcagccacgcaggtcttcttcgccctggggctgggctttggaggtgtcatcgccttttccagctacaacaaacaggacaataactgccacttcgatgctgccttggtgtccttcatcaacttcttcacctccgtgttggccaccctcgtggtgtttgcagtgctgggtttcaaagctaacatcatgaatgagaagtgtgtggtcgagaatgctgagaaaattctagggtacctcaactccaatgtcttgagccgggacctcatcccaccccacgtcaacttctctcacctgaccaccaaggactactcagagatgtacaatgtcatcatgactgttaaggagaagcagttctcagccctgggcctggatccttgcctcctggaggatgagctggacaagtctgtgcagggcacaggcctggccttcatcgccttcactgaggccatgacacatttcccggcctctccgttctggtcggtcatgttcttcctgatgctcatcaacctgggcctgggcagtatgattgggaccatggcaggaatcaccacacctatcatcgacaccttcaaggtgcccaaggagatgttcacagtgagctgctgtgtctttgcattcttcgtggggctattgttcgtccagcgctccggaaactactttgtcaccatgtttgatgactattcggccaccctgccactcaccgtcatcgtcatccttgagaacatcgctgtggcctggatttacggaaccaagaagtttatgcaggagctgacagagatgctgggcttccgaccgtaccgattctatttctacatgtggaagtttgtgtctccactgtgcatggctgtcctcaccacagccagcatcatccagctgggggtgtcacccccaggctacagtgcctggattaaggaggaggccgccgagcgctacttgtacttccccaattgggccatggcactgctgatcaccctcattgctgtggcaaccctgcctatccctgtggtgttcatcctgaggcacttccacctgctctctgatggttccaacaccctctccgtgtcctacaagaagggccgcatgatgaaggacatctccaacctggaggagaacgatgagacacgcttcatcctcagcaaggtgcccagtgaggcaccctcccccatgcccacccaccgctcctatctggggcctggcagcacatcacccttggagagcagcagtcaccccaatggacgatacgggagcggctacctcttggccagcacccctgagtcagagctgtgaccacagctccaccctgcctgcctcccctcaatacccacctgcccacttggccgggcctgttctcttcctccatggtgccaccagacccaggccagtccaaggattgaggatctgtcctgccttgttccccacccaagtcccggcagacttcctacctatgagcaggggactggggacagttcagtccctattccaggcccccaacccatgtaactttttgagaactcttgccaagttgcagccatgtaaccacaacaatcccagtatggggggacttcaagtgggcactttaggtgtcacctcctcttctccctgtaaaacctatcacttgctgttcttgggtttcagggagggtccatttgtgccactggtcaatgtggtggtggacagaggcttcagggctgagggtgcaggaggtggacgttagcccagcccatcataagaacagggctcattgtcctgtctaacccagccaggctgctcgtgagctaagatagggatagggacgcgtgggtcaggactcgggctttgctttggcaggaggtatatgggatctcctcaattctgtcctatgagaagcagagccctctcaggcttaagcatgaacgctggcattaaagaaatgaatccagttggctcatggagtctttgaatgttcctgtttaccccaacaggggcaaagaggggtatattcttgatcctgcccgagagcatagtgatggggctgtttctatgcctttgtgggcttcgatgtcattgcccctccagtgaggaggccaaaaacccacggtggccgtgcccaggcgg

SEQ ID NO: 4337 - DNA, 206 bp, Rattus norvegicus
  Genbank Accession No. S69315
gggggtggaggcggctcctgcgaccgaaaaggacttgcgactctccggccacgcaccatgagggtcctgtgggtgctgggcctctgctgcgtcctgctgaccttcgggtttgtgagagctgacgatgaagtcgatgtggatggcacggtagaagaggacctgggtaaaagtagagaaggctcacggacagacgatgaaggttgtgc

SEQ ID NO: 4338 - DNA, 195 bp, Rattus norvegicus
  Genbank Accession No. S69316
actctcactatgaatcctgtgtggagagggaatgtgacattttaaagttatttcttttgagagacttgttttggatgctcccccaagcctccctctcccctgcactgtaaaatgttgggattatgggtcacaggaagaagtggtttttttagttgaatttttttttttaacattcctcctgaatgtaaatttgta

SEQ ID NO: 4339 - DNA, 2986 bp, Rattus norvegicus
  Genbank Accession No. S70011
gtgctcctgggggcggcgcgcgggaccgtggcgcttccggcagcgggaggcggcacggagcgggaccgagaggcgcgggtggcggccggggaggcggatctgggacaatgtctggggaagtgccacccaacattaacatcaaggagcctcgatgggaccagagcacgttcattggccgagccagtcacttcttcacggttactgatcccaaaaacatccttttaacgaacgaacagctagagaatgcgaggaaagtggtacacgattacaggcaaggaatcgttcctgccggcctcacggaaaatgagttatggagagcgaagtacgcgtatgactcggccttccatcccgacacgggtgaaaagatgactctgataggaagaatgtcggctcaggtcccgatgaacatgaccatcacgggctgcatgatgaccttctaccggaccacaccggctgtgcttttctggcagtggataaaccagtccttcaatgccgtggtcaactacaccaatagaagtggtgacgctccccttactgtaaatgagctgggaacggcttatgtttctgcaacaaccggcgccgtggcgacagcccttggactcaatgccctaaccaagcatgtgtcgccgctgataggacgttttgttcccttcgctgctgtagctgctgctaactgcattaacatcccgctgatgagacaaagggaactcaaggttggtattcctgtcactgatgagaatggcacacgcttgggagaatcgaccaacgcagcaaagcaagccatcacgcaggtggtcatctccaggatcctcatggcggcccctggcatggccatccctccgtttatcatgaacaccttggagaagaaagcctttttgaagaggttcccgtggatgagcgcaccaattcaagtcacgctggttggcttttgtttggtgttcgccacccccctgtgctgtgctctgtttcctcagaagagttccatgtctgtgacaagcttggaggatgatttgcaagccagcatccaaaagagtcatcctgaattacggcgtgtgtactttaacaagggcctgtgaagccaagatcaagtgctggaggcacctcctgccatctgtgaacctcctgaagccaagcagtgaggaaatacgtgtgctgggcactccccgctacaaaagcctctgcaaaatctgtgttagagtcaagctgcctgtcaggagcctgacatttgaatcatgttgtaatttacaaaaaatacccttctggtagattttaatgatgccgttttttccaaagcccccaccttgagctttcaaaagctctggtgggcatagcatatatgctccagttacacactcagcaaacactggttatcaatcattggaaaggttaccagctcaactatcacattctgtttctacttctctccactgggtctcagcaatgaattggaaacacaaaggtctaagacaaatatccaaatttaaatactaaggaaactatatctccagtttggcaatggaccagtccaaagtagaacctcaattaaaaaaattgaggttcagagcataaacactccatacaccttcctgaagtcagccatagaccagggtaggatgccttccctgccatcctggattcttcaactcttcaatgtgtttagtgttcttaaaatattaattgtacctcacaggtactttatatcatgaatttccatcaaatacttaactgaaatggtctattcagtaccagtacaatgtgacattgactgggtgaccggtttttcagaagtgaaaccatagtccctatatgcctttttccccccatccttgtagaatttctttggctttcaggaagatatacagaaaccacacaaactagtccagcaactgtgcacattgtgctgcgttccaccctgtttgaagaccatgaagtcttgtggcatgtcaacatttctatggtgattttacatgtgacatattgggtgtagctgaggttgctttggaagtctgtggctattccacgtcatagacaagccacttgttacgctgagtgaaaaatcattgttaattcagatatttgtacgtggaaaaaaaccccacaaaaatagagactatctagtttctgtagattctttttcccaatgtttccagattgaatttcctcataaagaaaatatggtgtgccttgtgtctgtgcttctccttcctctgaaaggatggatggatctgaagcccccagccctcccccatgctgctagaatcttctgtggcgatgaccgccaaaccacctgaaatgcagtggctccctgtggcactctggcctcggacgagcctcactgccttcagtgcttctgttttaaacggtggtgagagcctggagctcaaggcagagtccacaggtgcttaaagaacactttcagaagaagctgaaggcctcgaggtctgttcatcaagccaatctcagagtccttgccccagtgcgtgtgtagctctgagaatgtgaagactcagttggaagatggtccaactcaccaagtgtcggcccagttagtgagaaacgcgcagtagacatggagctgggctcttttgaatttgttttgtgaagtgtcggcctcttactgcttttgtatagtgatactcactgtgtggtttaatcatgatttataaaaaaaaaagaagcaaatgaatgaaaattggcaatctttgctgatcttctaaaaatacttttttttcctgaagaaaaaagccacatgaagtgcaataatgttgtgcggtgacttgctgatagttctctgacgagagatagttatgtgtgtgtgactggctggcagatatcagtattagcgaggtctcttgccaatatcagagtcagtgtgtcatttcagtttaactggatgaactgtcaaataaatgcagaatgaaaataaacgactcttatttgtccgtgaaaaaaaaaaaaaaaaaaaaaaaaaaaaaaaaaaaaaaaa

SEQ ID NO: 4340 - DNA, 742 bp, Rattus norvegicus
  Genbank Accession No. S74257
tttttttgtgccactgcttcctctctagccgtgagactccagctacttcactatgcgacttctcaccctctccggtttgttcttcatgctgttcctctgtctctgcgttctctcctcagaagggagaaagcgtcctgccaagttcccgaaactcaggcctgctgtcatctatctcctagatccaaaccaataactggaaaggaaaccacacaagaccctgcagaccatgcagaaagctagaatccaattcatggggtggtgcctggggctctcccacagatatagggcctcccgaagctggcctccaccgagatgaaacgttgatgtccagttatggagacaaccttctggcccctaccaaccttcatggccagaaagctgtgacaccagaatgtttcacttcagacagctgaaggattacagaattccaagccctcgttccaaaggtgcaaccaaccttcagagtcactatgatccagggtcagcccacaagtcttcatggctcctgcagagtaaaagtccaagattccatccctgggagctacagattcagagacttccaagctgactggcgaacagagtagcaagacttccttgtgatcagatgagattacagcatcttaggaaccctcggacacccccaaacccatagcatttaatcaacgggatatgaaccaactcctgtaacttcctaatgtaatcaccaggagaacaccaaaaataataaatcataaatcaatgt

SEQ ID NO: 4341 - DNA, 1361 bp, Rattus norvegicus
  Genbank Accession No. S74801
cagttgtcagtgtctgagctggagcagaagtaccagaccagtgccaccaagggcctgaaggcgagtctggcagctgagctgctgctgagggatgggcccaatgcactccggccacctcggggcacccccgagtacgtgaagttcgcccggcagctggcaggcggtctgcagtgcctcatgtgggtggctgcagccatctgcctcattgcctttgcgattcaggccagcgagggagacctgaccactgatgacaatttgtacctggcgttggcactcattgctgtggttgtggtcactggctgttttggctactaccaggagttcaagagcacaaatatcatcgccagcttcaagaatcttgtaccccagcaagccacagtgatccgagacggggataagttccagatcaacgcggatcagcttgtggtgggcgacctggtagagatgaaaggcggggaccgcgtcccagcagacatccgaattctgtcagcccagggctgcaaggtggacaactcctcgcttactggagagtctgaaccgcagacccgctcacctgagtgtacacacgagagtccccttgagacccgcaacatcgccttcttctccaccatgtgtctggagggcacggcgcagggcttggtggtgagcaccggtgatcgcaccatcattggacgcatcgcctctctggcttcgggtgtggaaaacgagaagactcctatcgcgatcgagatcgaacattttgtggacatcattgctggcctggccatcctcttcggtgccacattctttgtggtggccatgtgtatcggctataccttccttcgggccatggtcttcttcatggccattgtggtagcctatgtgcctgaggggctgctggctactgtcacggtctgcctgtcactgacagcaaagaggctggccagtaaaaactgtgtggtcaaaaatctggaagcagtggagaccctgggttccacgtcagtcatctgctcagacaagacaggaactcttactcagaaccgcatgacggtgtctcatctatggtttgacaaccatatccacacggcggacaccacagaagaccagtcagggcaaacgttcgaccaatcgtcggagacctggcgggcgctgtgccgcgtgctcaccctgtgcaaccgcgctgccttcaagtctggccaggacgccgtgccagtgcccaagcgcatcgtgatcggagacgcatctgagactgcgctgctcaagttctcggagttgacgttgggcaacgccatgggttatcgggaccgcttccccaaagtttgcgagatccccttcaactccaccaacaagtttcagctgtccattcacactctggaggatcc

SEQ ID NO: 4342 - DNA, 3300 bp, Rattus norvegicus
  Genbank Accession No. S74907
cggtcgcacaccccccggtgtcccctcgcctccctcgccgccgcccccttcccccgctcgcgataagaagagccggcggcaggagaggggatgaagatggcggacgcgaagcagaagcggaacgagcagctgaagcgctggatcggctccgagacggacctcgagcctcccgtggtgaagcgccagaagaccaaggtgaagttcgacgatggcgccgtcttcctcgccgcctgctccagcggcgacacggacgaggtcctcaagctgctgcaccgcggcgccgacatcaattacgccaatgtggacggactcaccgccctgcaccaggcttgcattgatgacaatgttgatatggtgaagtttctggtagaaaatggagcaaatatcaatcaacctgacaatgaaggctggattccactccatgcagccgcttcctgtggatatctggatattgcagaatttttgattggtcaaggagcacatgtaggagctgtcaacagtgaaggtgacacacctttagatattgcagaggaggaagcaatggaagagctacttcaaaatgaggttaatcggcaaggtgttgatatagaagcagctcgaaaagaagaggaacgcataatgcttagagacgcgaggcagtggttgaacagtggtcacatcagtgacgtccggcatgcaaagtccggaggcacagcactccacgtggcagcggccaaagggtatacagaagttttaaaacttttaatacaggcaggctatgatgttaatattaaagattatgatggctggacacctcttcatgctgcagctcactggggtaaagaagaagcatgtcggattttagtggacaatctgtgtgatatggagacggtcaacaaagtgggccaaacagcctttgatgtagcagatgaagacattttgggatatctagaggagttgcaaaaaaaacaaaatctgctccatagtgaaaagcgggataagaaatctccactgattgaatcaacagcaaatatggaaaataatcaaccacagaagacttttaaaaacaaggaaacgttgattattgagccagagaaaaatgcatctcgaatcgagtctctggagcaagaaaaggctgatgaggaggaggaaggcaagaaggatgagtccagctgctccagtgaggaggatgaggaggatgactccgagtccgaagcggagacagataagacaaaacccatggcttctgtaactaatgctcacactgccagcactcaggcagctcctgccgctgtgacaacacctactctgtcttccaaccaggggacccctacatcacctgttaaaaagtttcctacatcaactacaaaaatttctcccaaagaagaagaaagaaaagatgaatctcctgcatcctggaggttaggacttagaaagactggcagttatggtgccctggctgagatcactgcatctaaagaagctcagaaggagaaagacactgcaggcgtgatacgttcagcttcgagtcccagactctcgtcctctttggataataaagaaaaggagaaagacaataaaggaacaagacttgcatatgtcgcccctacaatcccaaggcgactaggcagtacgtctgacattgaagagaaggaaaacagagagtcttcaaatttgcgaacaagtagttcttacacaagaagaaaatgggaagatgatcttaaaaaaaatagttcaatcaatgaaggatctacttaccatagaagtacctcaaatcgtttgtgggctgaggatagtactgagaaagagaaggacagtgctcctaccgcagcgaccattcttgttgctccaactgttgtaagtgctgcagcttcttctaccacagccctgaccacaactactgctggcactctttcctccacatcagaggtcagggagagacgcaggtcatacctcactcctgttagggatgaagagtctgaatcccaaaggaaagcaagatctagacaagcaagacagtctagacggtcaacacagggggtgacactgactgacctccaggaagccgaaaagacaataggaagaagccgttctacgagaaccagagaacaagaaaacgaagaaaaagacaaagaagaaaaggaaaagcaggataaagagaaacaagaagaaaagaaggagtcagaagtatctagagaagatgaatataagcaaaagtattccagaacatacgatgagacttatgcacgttacagaccagtgtcaacttcaagttcaagcactccgtcgtcctcctcactttctactctaggcagttcactctatgcctcaagtcagctcaacaggccaaacagccttgtaggtataacctctgcctactcccggggattaaccaaagacaatgaaagagagggagagaaaaaagaagaggaaaaagaaggggaagataagtcacaacctaaatcaatcagagaacgacggcgaccaagagaaaaacggaggtctactggagtctccttctggacacaagatagtgatgaaaatgagcaagagcggcagtcagacaccgaggatggctccagcaagagggacactcagacggattctgtttccaggtatgacagcagttccacgtcatcaagcgatcggtatgactccttgctgggtcgttctgcctcatacagttacttagaagaaaggaaaccatatggtagccgactagaaaaggatgactcaactgacttcaaaaagctttatgaacaaatcttagctgaaaatgaaaaactaaaggcacagctacatgacacaaatatggaactaacggatctaaagttgcagttggaaaaagctacccagagacaagaacgatttgctgacaggtcactattggagatggaaaaaagggaacgaagagctctagaaagaagaatatctgagatggaagaggagctcaaaatgttaccagacttaaaagcagacaaccagaggctaaaggatgaaaatggggccttgatcagagttataagcaaactttccaagtaggacagaaaacacacaagcgaagcagcgggacttgcacacactccccagtggaccacattggcagtcactggacgccagaaagaacccctggagactgtcattttccgatatcctgccaaacgccctcttatctaggagttttgtttcgtttaatcttctgccccacccccttggttatcaagaccattgtttcatgttaaagccgctgctgagaagattttttttcaatgactgagaaaacttgtttacagctccagcaaataaagaaagtgttcaagg

SEQ ID NO: 4343 - DNA, 879 bp, Rattus norvegicus
  Genbank Accession No. S75019
agcttggttcttccctccgctctgtttgccgccgtgggaacagccggccagaggtgtaccactgtgaggcgactgtttttgcacgaaagcatccatgatgaagttgtagacagactgaaaaatgactactcacagatccgtgtcgggaacccctgggaccccaatatcctctatggaccgctccacaccaaacaggcggtgagcatgtttgtgcaagccgtggaagaagcaaagaaagaaggaggcacggtggtctatgggggcaaggtcatggaccaccctggcaattatgtggaacccaccattgtgactggtcttgtccatgatgcgcccattgttcacaaggagacttttgccccaattctctatgtcttcaaattcaagaatgaagaagaggtctttgaatggaacaataaagtaaaacaggaactttcgagtagtatctttaccaaggatctgggcagaatcttccgctggcttggacctaagggttcagactgtggcattgtgaacgtcaatattcctaccagtggggctgagatcggcggtgcgtttggaggcgagaagcacacgggcagtggcagggaatctggcagcgatgcctggaagcagtacatgcggagatctacgtgtaccatcaactacagcacggccctccctctggctcaaggtatcaagtttcagtgatactggttggtcacttagccattcctgtgactgctctgaagacgcccaagaggactctgactttcccggaataaatgatcgatttgagtacagcagtgcctactctccagtgatcaaacccctgactaaatcaagatatatccatttatcaagaattgaaaattaaatatttacaacctagctacatttagc

SEQ ID NO: 4344 - DNA, 1134 bp, Rattus norvegicus
  Genbank Accession No. S75997
caagcggaggaagagctaccagcagctgcgacgaagactgcctttcttcctccttgcctttctcactcagtggccctgttaaacaagattgtgagtttctggaaaaaaaaaaaaaaaaaaaaaaaaaaaaaaaaaaaaaaaaaaaaaaaaaaaaaaaaaaaaaaaaaaaaacaggtgacaatgccaagtctgtgagcagacagtattctctgaaggtaacgaagctggagcatgaggctgagcaggcaaaggtggagctggactttatcctgtcacagcagaaggagctggaagaccttctgagcccgttagaggagtcagtgaaggagcaaagtggcaccatctaccttcagcatgctgatgaggagcgtgagaagacctacaagctggctgagaacatcgatgctcagctcaagcgcatggcccaggacctcaaggacattattgagcacctgaacatggctggtggccctgcagacaccagtgacccactgcagcagatctgcaagatcctcaatgcacacatggactcccttcagtgggtggaccagagctctgccctgctgcagaggagggtggaggaggccagccgtgtgtgtgagagccggcgcaaggaacaggaacgcagcctgcgcattgcctttgactagccatacatgagttgggggtgggggtacctcttttgttgtagggctgctggctttggggtggttgtattgttgagaaaaatgctctttggtttggttccctgttatcagaagtggtttgcgaaggcatgatgtcatggatgtaataacctgtgtgctctggagacaggtgtgaaggtcactgaactctaggccagcatttaaagaacaagggcaaactcatcctttagccactccaatacaactgtgacagtgggtcactggtgtctgcagggccaccagccatgttcaggtgctcaataatgtccttgaggtcctgggccatgcgcttgagctgagcatcgatgttctcagccagcttgtaggtcttctcacgctcctcatcagcatgctgaaggtagatggtgccactttgctccttcactgactcctctaacgggctcagaaggtcttccagctcctgcagctgctttcgggtttcgtgccg

SEQ ID NO: 4345 - DNA, 1747 bp, Rattus norvegicus
  Genbank Accession No. S76054
gcagctgctccgctcgctctcgaacctccgtcttcagctcactgccttcactccagacttcaccatgtccgtcagggtgactcagaaatcctacaagatgtccacctccggtccccgggccttcagcagccgctcgttcacgagtggacccggtgcccgcatcagctcttccagcttttcccgggtgggcagcagcagcagcagcttccgcggaagcctgggcggctttggcggggctggtgtcgggggcatcacggcggtcacggtgaaccagagcctgctgaaccccttgaagctggaggtggaccccaacatccaggctgtgcgcactcaggagaaagagcagatcaagaccctgaacaacaagttcgcctctttcattgacaaggtacgcttcctggagcagcagaacaagatgctggagaccaaatggagcttgctgcaacagcagaagacatccaggagcaacatggacaacatgtttgagagttacatcaacaacctccgtcggcagctggaagccctgggccaggagaagctgaagctggaggtggagcttggcaacatgcagggcctggtggaggacttcaagaataagtatgaggatgagatcaacaagcgtacagagatggagaatgagtttgtcctcatcaagaaggatgtggatgaagcctacatgaacaaggtggagcttgagtcccgcctggaaggactgaccgacgagatcaacttcctccggcagatccatgaagaggagatccgtgagctgcagtctcagatctcagacacgtctgtggtgctgtccatggacaacagccgctccctggacatggacagcatcattgctgaagttcgtgcccagtatgaggagatcgccaaccgcagccgagctgaggccgaaaccatgtaccagattaagtatgaggaattgcagaccctggctgggaagcacggggatgatctacgtcgctcgaagacggagatctctgagatgaaccgtaacatcagccgcctgcaggcggagattgacgccctcaaaggccagagggcaaccctggaggcggccattgctgatgcagagcagcgtggggaactggccgtgaaggatgccaatgccaagctggaggatctgaagaatgccctgcagaaggccaagcaggacatggcccggcagctgcgcgagtaccaggagctgatgaacgtgaagctggcgcttgacatcgagatcgccacctaccgcaagctgctggagggcgaggagagcaggctggagtctgggatgcagaacatgagcatccacacgaagaccaccagtggctacgcaggaggactgagttcatcctacgggggactcactagccccggcttcagctatggaatgagctctttccagcccggcttcggttctgttgggggatccagcacttatagccgcaccaaggctgtggtcgtgaagaagattgaaacccgagatgggaaactggtgtctgagtcttgtgacatcatgtccaagtgaatggccactgaagtcattgccagcctgaggtcctgcagctgctcaggggtcaaggggagacagctgtatggcagagtgcagggaactagggaccagccagagtaccagccctaaacctctggccaaccttgggaggaatttctatctgggatatgccaatgcccaactcaattgtattttccaaaataaagcctcagtggctgtaaaaaaaaaaaaaaaaaaaaaaaaaaa

SEQ ID NO: 4346 - DNA, 2275 bp, Rattus norvegicus
  Genbank Accession No. S76466
ggcggcggttactatggcggagtcggccggagcctcctccttcttcccccttgttgtcctcctgctcgccggcagtggcgggtccgggccccgggggatccaggctctgctgtgtgcatgcaccagctgcctacagaccaactacacctgcgaaacagatggggcctgcatggtctccatctttaacctggatggcatggagcaccacgtacgcacctgcatccccaaggtggagcttgtgcctgctgggaagcccttctactgcctgagttcagaggacctgcgcaacacgcactgctgctatattgacttctgcaacaagattgacctgagggtgcccagtggacacctcaaggagcctgagcacccctccatgtggggccctgtggagctggtcggcatcattgccggtcctgtcttcctcctcttcctcatcatcatcatcgtcttcctggtcatcaactatcatcagcgtgtctaccacaaccgccaaagactggacatggaggacccctcatgtgagatgtgtctctccaaagacaagacgctccaggatctcgtctacgatctctccacttcaggatcgggctcagggttacccctttttgtccagcgcacagtggcccgaaccattgttttacaagagattatcggcaagggccggtttggggaagtatggcgtggccgctggaggggtggtgatgtggctgtgaaaatcttctcttcccgtgaagagcggtcgtggttccgggaggcagagatctaccagactgtcatgctgcgccatgaaaacatccttgggtttattgctgctgacaataaagacaatggcacctggacccagctgtggcttgtctctgactatcacgagcacggctcactgttcgattatctgaaccgctacacagtgaccattgaggggatgattaaactggccctgtctgcagccagtggtttggcacacctgcatatggagattgtgggcactcaggggaagcctggaattgctcatcgagacttgaagtcaaagaacattctggtgaagaagaatggcatgtgtgccattgcagacctgggcctagctgtccgtcacgatgctgtcactgacaccatagacattgctccaaatcagagggtgggaaccaaacgatacatggctcctgaagtacttgacgagaccatcaacatgaagcactttgactccttcaagtgtgccgatatctacgccctcgggcttgtctattgggagattgctcggaggtgcaattctggaggagtccatgaagagtatcaactgccatattatgatttagtgccctctgacccttccattgaggaaatgcgaaaggtcgtctgtgaccagaagctacggcccaatgtccccaactggtggcagagttatgaggccttgcgagtgatggggaagatgatgcgggagtgctggtacgccaatggtgctgcccgcctgacagcgctgcgcatcaagaagactttgtcccagctaagcgtgcaggaagacgtgaagatttaagctgttcctctgcctacgcaaagaacctgggcagtgaggatgcctgcagccaccgtgcaagcgtggaggcctacctcttgtttctgcccagccctctggccagagccctggtctgcaagagggacagagcctgggagacgcacactccctactgggtttgagacagacactttttatatttacctcctgatggcatggagactctgagagcaaatcatgtagatgactcgatgccacaactcgcactgcgtgcagtgggaaggacagaaagcccagtgcatctggcatgttgccaggagtggtgatgggtgctgggctcgcctgggagcagcccccataccgtgttgtccactggactgcaggtttcctccagggaccagtcaactggcagatactgagaggaaccggaagtgtcctcccttttacctgtgggcagtcctgagccacgccatccccttctcatctggaggaccgcccctagagacacaacctgctgcctgtctgtccagccaagtgcgcatgtgccgaggtgtgtctcacattgtgcctggtccgtgcctcgcccgtgtgtgtgtgtgtgtgtgtgtgtatgtgtgtgtgtaggtgtgtgtgagtgtgtgtgttagtgtaggtgtgtgagagtgtgtgtgtaggtgtgtgagtgtgggtgtgtgagagtgtgtgtaggtgtatgtgagtgtgtaagtgtgtgtaggtgtgtgagtgtgtaggtgtgtgagtgtg

SEQ ID NO: 4347 - DNA, 613 bp, Rattus norvegicus
  Genbank Accession No. S77858
gcagcagccaagatgtgtgacttcaccgaggaccagaccgcagaattcaaggaggctttccagctgtttgaccgaacaggcgatggcaagatcctgtacagccagtgtggggatgtgatgcgggccctgggccagaaccctaccaacgccgaggtgctcaaggtcctggggaaccccaagagcgatgagatgaatgtgaaggtgctggactttgagcacttcctgcccatgctgcagactgtggccaagaacaaggaccaaggaacctacgaggattatgttgaaggccttcgtgtgtttgacaaagaagggaatggcactgtcatgggtgctgaaatccgtcatgtcctagtcacactgggggagaagatgacagaggaagaagtcgagatgctagtggcggggcatgaggacagcaacggttgcattaactatgaagagcttctccggatggtgctgaatggctgaggacatttacgtgtctcgagcctgctccttgcccagtgtgagattcctgtgtggccccagaggctccctaatcacagcaccttgcctgtctggtttcttttggatgatgtttgccttcaccaaataaaacttgctctctgtgctc

SEQ ID NO: 4348 - DNA, 3001 bp, Rattus norvegicus
  Genbank Accession No. S78556
cggcacgagtgttcttgccctcgtagccctctgtccagccgccatgataagcgccagcagagccgcggccgcgcgtctcgtgggcaccacagcgtcccggagtcccgccgccgcccgtcaccaggatggctggaatggccttagtcatgaggcttttagatttgtttcaagaagggattatgcgtcagaagcaatcaagggtgcagttgttggaattgatttgggtactactaactcctgtgtggctgttatggagggcaaacaagccaaggtcctggagaacgccgaaggtgccagaactaccccttctgtggttgcctttacaccagatggggagcgacttgttggtatgccagcaaaacgacaagctgtcaccaatccaaacaataccttctatgctacaaagcgtcttattggacgacgatatgatgaccctgaagtacagaaagacactaagaatgttccctttaaaattgtccgtgcctccaatggtgatgcctgggtggaggctcatggaaaactctattctccgagtcagattggagcgtttgtgttgatgaagatgaaagagactgcagaaaattacttgggccatacagcaaaaaatgctgtgatcacagtccctgcttatttcaatgactcacagcgacaggccactaaggatgctggccagatatctgggctaaatgtgctccgagtgatcaacgagcctacagctgcagctctggcttacggtctggacaaatccgaagacaaagtcattgctgtatatgatttaggtggaggaacctttgacatttctatcctggaaattcagaaaggagtgtttgaggtgaaatccaccaatggggacactttcttaggaggtgaagactttgaccaagctttgttacggcacattgtcaaggagttcaagagggagacaggggttgatttgaccaaagacaacatggcgcttcagagggttcgggaagctgctgagaaggctaaatgtgagctctcctcatctgtacagactgacatcaacttgccataccttacaatggatgcttctggaccaaagcatttgaatatgaagttgactcgagctcagtttgaaggcattgtcacagatctaatcaagagaactattgctccgtgtcagaaagctatgcaggatgcagaagtcagcaagagtgacataggagaagtgatcctggttggtggcatgacgaggatgcccaaggttcagcagactgtgcaagatctttttggcagagccccaagtaaagctgttaatcctgatgaggctgtagccattggagctgccattcaaggaggtgtgttggctggtgatgttacagatgtgctactcttggatgtcactcccctctctctaggtattgagacacttggaggtgtctttaccaagcttattaataggaacaccactattccaaccaaaaagagccaggtattttctactgctgctgatggacaaactcaagtagagattaaagtgtgtcagggggaaagagagatggccggagacaacaaacttctaggacagttcactttgattggaattcccccagcccctcgtggagtgcctcagattgaagttacatttgacattgatgccaatgggattgtgcacgtttctgccaaagataaagggacaggacgtgagcaacagattgtaatccagtcttctggtggattaagcaaagatgatattgaaaacatggttaaaaatgcagagaagtacgctgaagaagaccggaggaagaaggaacgtgttgaagcagttaatatggctgaaggaattattcatgacacagaaaccaagatggaagaattcaaggaccagttgcctgctgacgagtgcaacaagctaaaggaagagatttccaaaatgagagaactccttgctcgaaaggacagtgaaacaggagaaaacattaggcaggcggcatcttcccttcagcaggcatcattgaaactctttgaaatggcatataaaaagatggcatctgaacgggaaggttctggaagttctagcactggggaacagaaggaagatcagaaggaagagaaacagtaatagtggcagtgcattgtggagctaggacgacatactatgaagcttgggagtaaaggaacttcctgagcagaaaaggggcaaacttcagtctttttactgtatttttgcagtattctatatataatttccttaatatataaatccagtgacaatatataaatccagtgacaatagctataactcatttaatggtaataaagtcagcaatagcaggttcacacttctataactagcctgctgttttcagctgcacgtaaaggggtgggatggggctgtgtaccaatcattattaggtaaatctggtttgtgctgaagtagctatgttttcgagatggaagcccatttcacatgcagtagaggtaatctgtcatggaccttgaattgaggttcatatgcagatgcttgttgaccaagagcactgctataaatgacctgtgtgtacatttgctccttcaactgatgccttgcaagactaagctctctgtgtcatggtctataggtacagaagttaggtcaatggataacagctgtgttagccatagcttaaagtgatctatcaagaattatacaagcctctcatgggcctaaggcatacttctccagctaccctcttgggtggccaatgtctgacatctatattcttgatgattgttcctttttcatccattctggattttttttttttttaataaaattctgaaagcctcttgatctcctttgtgaatggtagtagctcaaggactatgactgtaccatcaggtttgtgagtagaggtaaaaaatcaacactggctaaaaggttgaacaaattaaacatggtgagggactaaataacatgttggcatgtatgctggatgtggaagcccactcaggaagcagtgtgaagccaggcggggctacacaatgagacaccccgtct

SEQ ID NO: 4349 - DNA, 867 bp, Rattus norvegicus
  Genbank Accession No. S79213
tggtagtggtttccgcgacaggcaggtgcgactgctttagcccggcctgggctccacggctgcctggagggtctctgcagtgcccaccccttctcctccgggaccccacgccagcagcgaccctgagccagcagccggagcgaccggcaatggcggcctcgacggcctcgcaccggcccatcaagggaatcctgaagaacaagacctctacgacttcctcggtggtggcctcggccgaacagccccgccggaccgtcgaagaggagctgagtaaaaagtctcagaagtgggatgaaatgaacatcctggcaacatatcatccagctgacaaagactacggcttgatgaagatagacgagccagacactccataccacaatatgataggtgatgatgaagatgtctgtagtgattcagaaggcaatgaagtcatgactccagagatcttagcgaaaaagttagctgctgctgagggctccgagccaaagtttcggactcgggaacaagaaagcagtggagaggaagacaatgacctctcccctgaagagcgagaaaagaagcggcagtttgaaatgaaaaggaagcttcattacaacgaaggactgaatattaaattagccagacagttaatttcaaaagacctacatgatgatgacgaagatgaagaaatgtcagagactgcagatgcagacagcatgaatattgaagagtcaaatcaaggatctactgcaggcgaccatctgcagcacaaatcacaaagttcataaacgtgttcatcagtgcagtcgttgtcaaatacaaaccttgttacttataccacactgcttcttgttctctacgactcgtgactatgtaccaaaatacaca

SEQ ID NO: 4350 - DNA, 380 bp, Rattus norvegicus
  Genbank Accession No. S81025
gggacaccaagatagcattttggtacaaataagagacccgaggatggccagagacctcagatgtgtgtctctgccagtcgactgggctggtccctctcatttgttcagtctgaatgatagttctccttccttaccattcagacatctttccagatgcccagggtgaatgtcacgtttacccacaacctggctcggcactgggtgaaattctacaaggtgtttatcagtgtaaaaacggtcagcctttggagaggtttcttggacacgtcacccccaaagagtcggaactgtgcccagctccaaccttagtgactgtgggtcatagtcccagtgctgaaactgctgaagtgtgacatgggtaagagctttgctttagtcgg

SEQ ID NO: 4351 - DNA, 901 bp, Rattus norvegicus
  Genbank Accession No. S81448
taatcttcaaacttctcatggtaccactgatggagttggatgagctgtgcctgctcgacatgctggtctacttggaaggtttcatggccttcgtgtccattgtggggctccggtcggttggctctccgtacggccgctactcgccgcagtggcccggcatccgagtgcccgcgcgacctgcctggttcatacaggagctgccctcgatggcctggccgctgtacgagtacattcgtcctgcagccgcgcgactgggcaacctgcctaaccgcgtcctgctggctatgtttctgatccactacgtgcaaaggacgctggttttcccggttctgatcaggggagggaagcccaccctcctggtcacctttgtcttggccttcctgttctgcaccttcaacggctatgtacagagcagatacttgagccagtttgcggtttatgctgaagactgggtgacccatccctgtttcctgacaggctttgccctgtggttagtgggcatggtgataaatatccactcagaccacatcctgaggaatctgagaaaaccaggggaaactggatacaagatacccaggggaggcctgtttgaatacgtatctgcagccaactattttggggagctcgtggagtggtgtggctttgcactggccagctggtccctccagggtgtagtgtttgcactgttcacactcagcacactgctcaccagagcgaagcagcaccatcagtggtaccatgagaagtttgaagattaccccaagtcaagaaaaatactgattccatttgtgctttagtgctctgttagcgctgttgcctcccatgagctgagtctgtctgtctccctggtgactttgctctgagcacttacgaatgaattgttttccttaattctcctgca

SEQ ID NO: 4352 - DNA, 897 bp, Rattus norvegicus
  Genbank Accession No. S83436
gcggcttcacgttcgcttctctctccactacagtatggggccggcgccgcgcgtcctggaactgttctacgatgtgctgtccccctactcctggctgggctttgaggtcctatgcagataccaacacctctggaatatcaagctgaagttgcggcccgctttactcgctgggatcatgaaagacagtggaaaccaaccaccagctatggttccccacaaaggccagtacatactcaaagagattcctctcctgaagcagctcttccaggttcccatgagcgtccccaaggatttctttggtgaacatgttaagaaaggaactgtaaatgccatgcgcttcctcaccgcggtgagcatggagcaaccagagatgctggagaaggtgtccagagagctgtggatgcgcatttggtcccgagatgaagatatcacggagtcccagaacattttgtctgcagcagagaaggccggaatggccacagcgcaagcccaacaccttctgaataagatctccaccgaactggtgaagagcaagctcagggagaccactggggcagcctgcaaatatggggcctttgggctgcccaccactgttgcccacgtggatggtaaaacctacatgctatttgggtctgaccgcatggagttgctagcttacctgctaggagagaagtggatgggccctgtgcccccaaccctgaatgccagactttaagattgccttagaaagtaaactttgacatctccatctgatgaagctgtcttctgtggccctgggggttgaaacaagagtccacctttagctgtggctgcctttacgtctgtgcctcccaagtgcctcttgaaaaaccttaagctctgcattcccataaataaacccgatgccactagacaaca

SEQ ID NO: 4353 - DNA, 1925 bp, Rattus norvegicus
  Genbank Accession No. S87522
catgcccgaggtcgaggatacttgttccttggcttctccagcctcggtctgccgaacccagcacctccatcttcgctgcagcgtcgacttcgctcgccgggcactgaccgggaccgccgcgctcacggtccagtcacaggaggataatctgcgcacgctgactttggatacaaaagaccttacgatagaaaaagtggtgatcaacggacaagaagtcaaatacactcttggagaaagccagggttacaaaggatcgccgatggaaatctcccttcccatcgctctgagcaaaaatcaagaggtcgttatagagatttccttcgagacgtctcccaagtcctcggcccttcagtggctcactcccgagcagacttcaggaaagcagcatccatacctcttcagtcagtgggaggccatccactgcagggcaatcctcccttgccaagacacttctgtgaagttaacctacaccgcagaggtatctgtccccaaagaactggtggctctcatgagtgccatccgtgatggagaagcccctgacccagaagaccccagcaggaagatatacagatttaaccagagggttcccataccgtgctacctgattgctttagtcgttggcgctttagaaagcaggcaaattggcccaagaactctggtgtggtctgagaaagagcaggtggagaagtctgcttatgaattctctgagactgaatccatgcttaaaattgcagaagatctggggggaccctatgtttggggacagtacgacctgttggtcctgcccccatccttcccgtacggaggcatggagaatccttgtctcacattcgtaacgcctactctattggcaggtgacaagtcactctctaatgttattgcacacgaaatatcgcatagctggacagggaacctagtgactaacaagacttgggatcacttctggttaaacgaaggacataccgtctatttagagcgccacatttgtgggcggttgtttggggaaaaattcagacatttccacgctttaggaggatggggagagctacagaacacgataaagactttcggggagtcccatcccttcaccaagctcgtggtcgatctgaaggacgtagaccccgatgtggcctactcctccattccctacgagaagggcttcgccttgctcttctacctggaacaacttcttgggggaccggaggtgttcctaggattcttaaaggcttatgtggagaagttttcctaccagagcgtaaccactgatgactggaagagtttcctgtatgctcactttaaagataaggtggatcttctcaatcaagttgattggaatgcctggctctatgctcctggcctgcctcctgtcaaacccaattacgatgtgactctcacgaatgcctgcatcgccttaagtcaaagatgggtcactgccaaagaggaagatttaaattcattcagcatcgaagacctgaaggacctctcgtcccatcagctgaatgagttcctggcacaggtgcttcagagggcacctcttcccttggggcacataaagcgaatgcaagaggtgtacaacttcaatgccattaacaattctgaaatacgattcagatggttacggctctgcattcaatcgaagtgggaagaagcaattcctttggccctaaagatggcaactgaacaaggaaggatgaaatttacacgacctctattcaaggacctcgctgccttcgacaaatcccacgatcaagctgtccgcacctaccaggaacataaagcctgtatgcatcccgtgaccgccatgctggtggggaaagatctgaaagtggattaaggaactgagtgttgctgatttcagaaaattcctttttttaagaaaaaaaatcgaacctattaagaaatacaaaattttagctctcgttgta

SEQ ID NO: 4354 - DNA, 511 bp, Rattus norvegicus
  Genbank Accession No. U01145
gccagatggggcaactcctggctcttggcctgggacttgtcttcaagatctctgctcttattagagaaagaactttagcatgaggaaaagtaagagaaaacaagttacatgggcatggtggtgtgctcctgcaatcccaatattaagaggttaaaaaataggaccagaagtttaaagtaatccttggctacctagtgagtgtaaggccagcctggaatcaataagagttggtttcaaagaagcaggaggagaaggaggaacaggaacaggaggaggagcagggggaggagaaaaaggaggaggaggaggaggaggaagaggaggaggaggaggaggaggaggaggaggaggaggaggaggaggaggaggaggagaagaagaagaagaagaagaagaagaagaagaagaagaagaagaagaagaagaagaagaagaagaagaagaagaagaagaagaagaaaaaaaaaaaaaaaaaaaaaaaaaaaaaaaaaaaaaaaaaaaaaaaaaaaaa

SEQ ID NO: 4355 - DNA, 70 bp, Rattus norvegicus
  Genbank Accession No. U01347
ggacagcctcccaccagcttcctggtctcaggccctgctacaccgggaaaccatggacattgaagcatac

SEQ ID NO: 4356 - DNA, 3378 bp, Rattus norvegicus
  Genbank Accession No. U01914
atggagcaaagctacggaggttatggggcatggagtgctggacctgccaacacccagggtacatatggaagtggtgtggccagctggcaaggttatgaaaactacagctactacaatgcccagaacaccagtgtccctacaggaacaccctatagttatggcccagcctcgtgggaggccaccaaggccagtgatggtggcctggcagctgggagttctgctatgcatgtggcctcttttgccccagagccatgcaccgacaactctgactcgctcattgccaagatcaatcaacgtttggacatgttgtccaaggaaggaggcaggggtgggatcagcagcggtggggagggcatgcaggaccgagacagctccttccgcttccagccatatgagtcctacgactccaggccctgtatgcctgagcatactccctaccgccccagctacagttacgattatgactttgacttgggaactgaccgcaatggtagttttggcgggacattcaacgactgtcgggacccaaccccagagcgaggcgcccttgatggtttcttaaggggccggggccagggccgcttccaggaccggagcaactcgagcaccttcatacgtagtgaccccttcatgccaccctcagcctcctcagagcccttatccaccacctggagtgagctgaactacatgggtggacgtggtctaggtgggccctccaccaacaggccgcctccttccctcttctcccagtccatggcccctgactacagcatgatgggcatgcagggggtgggcggttttggtggcaccatgccttatggatgtggccggtcccagactcggatacgggattggcccagaaggagggggtttgaacgctttggaccagacaacatgggcaggaagcggaagccgtttccattgtatgaagaacctgatgccaagctggcccgtgctgacagtgaaggagacctctctgaaaacgatgatggagctggtgacttacggtcaggagatgaagaatttaggggggaggacgacctctgtgactcccggaagcagagaggagaaaaggaggacgaggatgaggatgtgaagaagagacgggagaagcaaaggaggagagatcggatgcgggaccgagcagctgacaggattcagtttgcctgttctgtgtgcaaatttcgtagctttgaagatgaagaaatccaaaagcatctgcaaagtaaatttcataaagagaccttgcggtttataagtaccaaactacctgacaagacagtagaatttctccaggagtatatcataaacaggaataagaaaattgagaaacggcgtcaggagttgttggagaaggaaagccctaaacccaaaccagatccattcaaagggattggccaggagcatttcttcaaaaggattgaagccgcacactgcctggcctgtgacatgctgattcctgcacagcaccagctcctgcagcggcatctgcactctgtggaccataaccataatcgaaggttggctgctgaacaattcaagaaaacaagtctccatgtggctaagagtgttctgaacaacaagcatatagtgaagatgttagaaaaatacctcaagggcgaggatccttttgtcaatgaaactgctgatcttgagacagaaggagatgagaacttaggagaggagaaggagacaccagaggaggtagctgcggaagtcttagcagaggtgatcacagcagcggtgaaggctgtagagggggatggagaaccagctgcagagcatagtgacgtcctagctgaagtggaagggcctgtggacaccgccgaggctggtagtgactcccacactggaaagctgctagaagaacagacctgtgaaacagcatctgaaaccaggaacatggaagacatggccagaggtgaggctgctgaggccagaaatgaagcagctgtgccagcagcagccgccggaagcccagtacctgtcatagccatcccaggaatcctggaagatgagctggaacaaactgatgcagaggccaaagatactcccacagaataatgatcttctcttccctgtttcaagggacgtgttatatcatgtgttctttgttttataagctgtactggggtgtgtgttattcggtggaaagactgggccatttccttcccagtgtacctcaaggattgatgctatacagtagatggcttcccacctctgttagaaatacaaaaagaggtaaaccattttcccaagtggcctttgatggctatctgtgcactgcagctagaatagtaagagtagatcttcctgacacttgttgagtcctgaattggacagaatgtgaggatttttgttttgttttgtgttgtgtttttgtttggtcttcgtttcactttattttgctttttctcttgggaagcaatctgatacgaacatagcttacttgagaaaaaaattatttaggggaattcccttattcacctctgcatggttgatgtgggacatacacagttcaaccatccatgtgtgcaagagctgagattgtgccctccaccaataaacagtcttgtttcaataaacatcaggccatttcctaactgtcggcattgaaatagcatcttgcttggaccaagctagctttagaactcaatcctactgtttagcctctgcagtgctggtgccatgagtgtacggccatgctcagtggggctttggttttgcaatacactgtatcctatgttcctctccagctgtggcagcattagacagatgacatggcagtgacttggctgtgtttgagatggtccctcaggcttccactggaaggacccgcacctgagcctgtagatcgaagacactgctaaggccttggttctcactgttcagtgcttgctaatcagttggtgttcgtctcccacctctattagtggatgttttgttgtttgctctctttccttttgttatttccacctaaaggtatttagaaaaccatggaattactccattgatgaaaaacaaatgtggacttcatagttgggatctgtctgtcaaaagctcaaaccgttaagtaaaagtgtttgactaaagcaagtagtagtccgagcaaggagctagcatgtctctaaagcagcatgtgctaaggttttacaggctcagaatgatgggtctcccccgttttgaagttacaatgctgtgtccatttgtacacagctcacatcttggaaacatgagccagtgagggactacggaagagatggtagaccatcacagcaatttcatcagcacgtctgtctgttaaggagcattactggggatgtgatagggactttggaatatcattgtcaaaacaagcaataaattgatgccacggag

SEQ ID NO: 4357 - DNA, 648 bp, Rattus norvegicus
  Genbank Accession No. U02506
aatcccaatattaagaggttaaaaaataggaccagaagtttaaagtaatccttggctacctagtgagtgtaaggccagcctggaatcaataagagttggtttcaaagaagcaggaggagaaggaggaacaggaacaggaggaggagcagggggaggagaaaaaggaggaggaggaggaggaggaagaggaggaggaggaggaggaggaggaggaggaggaggaggaggaggaggaggagaagaagaagaagaagaagaagaagaagaagaagaagaagaagaagaagaagaagaagaagaagaagaagaagaagaagaagaagaagaagaagaagaagaagaagaagaaattagaagaagaaaagaagaaggacaaatggctcttttctggtctcaccttttcccttcctgtcactcatgtggacctcagataagagcacagatactctcgacctcttacatttggagagttttgagcagacaggaagaagacggagcctgggagcagctgttctccaatagtcaaattaagactgttcctctctgagctctgtacttcaaccagcacctttaggcagaagccatcaaatcagaaatgtctgttaataattaaagtctatgattgccaccaaaaaaaaaaaaaaaaaa

SEQ ID NO: 4358 - DNA, 1612 bp, Rattus norvegicus
  Genbank Accession No. U05675
aggcaaagggcaactgcttggaatttcagaaaatctgaaaccatgaggcatctatggctgctgctcctgtctgtttccttagttcaaactcaagctgcaactactgactccgataaagtggacctctcgattgcccgtggtcatcgacctgttgacaggagaaaggaagagcctcctagcctaagacctgcccctcctcctatcagcggaggtggctatcgagcccgtccagccaaagttgatgcaggtcagaagaaagtggaacgaaaaccccctgatgcaggaggctgtgttcacggtgacggagacatgggagtgctatgtgctacagggtgtgagttgcgtcaaactttgctaaaccacgaaaggccaatcaaaaacagtattgctgagttaaatagcaacataaactctgtttatgagacctcttcggtcacctttcagtacctgactctgctgaaagacatgtggaaaaagaagcaggcacaagttaaagataatgaaaatgtcataaatgagtattcctccattttggaagaccagaaattatatattgatgagactgtgaacgataatatcccccttaatcttcgtgtgctccgctcaatcctggaggacctgagaagcaaaatgcaaaaattggagtctgacatctcagctcagacggaatactgccacactccatgcaccgtcaactgcaacatcccggtggtgtctgggaaagagtgtgaagagatcattcggaagggaggtgagacatccgaaatgtatctcattcagcctgacacctccagcaaaccatacagagtgtactgcgacatgaagaccgaaaacggaggatggacggtcatacagaaccgtcaggatggcagcgtcgactttggcaggaaatgggacccatacaaaaaaggatttggaaatattgcaaccaacgaagatacgaagaagtactgtggcttgccaggcgaatattggcttggcaatgataagattagccagctcaccaggataggacccacagaactcctaatcgaaatggaggactggaaaggagacaaggtgaaggcacactatggaggcttcacggtgcagaccgaggccaacaagtaccaagtgtcagtgaacaagtacaaagggactgctggcaacgccctcatggaaggggcctctcagctggtgggggagaacagaaccatgaccatccacaacggcatgttcttcagcacctacgacagggacaacgatggctgggtaactacagatccaagaaagcagtgctcaaaagaagatggcggcggctggtggtataacagatgccatgcagccaatccgaatggcagatactactggggtggcctttacagctgggacatgtccaagcacggcacagatgatggtgtggtgtggatgaactggaagggatcgtggtactccatgagaaggatgtctatgaagatcaggcccgtcttcccacagcaatagtcccccaagcatagactttcagccttctatgtctgacattttttacattatgttattggaattttctttgatacattatatccactaatgctcaaaacaatggctgagtgtgtctttttttttttttttt

SEQ ID NO: 4359 - DNA, 1589 bp, Rattus norvegicus
  Genbank Accession No. U06230
aattggcttgaaaccagttgtagggggttcgaatcagaatctctcgatcactcaaattggctcctgattgcacttcgtgaagggaagattgaagttcagtttaagaatgagttttcaacccaaatcacaactggaggcaatgttattaacaatggtatatggaatatggtgtctgtggaagaattagacgacagtgttagcattaaaatagctaaggaggccgtgatgaatattaataaacttgggagtctttttaaacctaccgatggatttctggacaccaaaatatactttgcaggattacctcggaaggtggaaagtgcactcattaagccgattaatcctcgtctggatggatgtatacgaggctggaacttgatgaaacaaggagctttgggtgcaaaggaaatagttgaaggaaaacaaaataaacattgcttcctcactgtggagaagggctcctactaccctggttcaggaattgctcagttcagcatagactacaataatgtaactaatgcagaggattggcaaataaatgtgaccttgaatattcgcccgttcactggcactggggtcatgcttgctttagtttctggggacacagtgccctttgccttgtccttggtggattctggctctggaacttctcaggacattctggtatttgttgaaaattcagtagcagctcacttagaagccataactctgtgctcggaacagccatcccagctgaaatgtaacattaacagaaatggactggaactgtggaccccagttagaaaagacgtcatttactctaaagatctccaaaggcaactcgccatcttggacaaaacaatgaaaggaaccgtggccacttacctgggtggcgttccagatatttccttcagtgccacaccagtgaatgctttttacagcggctgcatggaagtgaacatcaacggggtacagttggatctggatgaagccatttccaaacataatgacattagagctcactcctgtccgtcagtgaggaaaatccagaagaacttctaaagtctgtttcctgggcttctaatctctcttttcatattgtaattatgctcttgttcatgtttccatcaccaaatggcaggattacatgtgttatatgcatgtttaaatatgatgtggtactttgtccttcagatttttgttatataagtcgcatttttgaaaagtcttgtactcactgctgtctagaaattaaataacaaaacacatgaaacatttaaatttcaatttatttcctataaatcttccagtgcgtcacaggcaacataatctgctccattgtctttggagagcgctttgactacagagaccgccagttcctgcgcttgctcgacctgttgtataggaccttttccctcataagctcattctccagccagatgtttgaggtctactctgacttcctgaagtactttcctggtgtccacagagaaatctacaaaaacctgaaggaagtcctcgactacattgatcatagtgtggagaaccacagggccactttggaccccaatgctccccgagactttatcgatactttccttctggaattc

SEQ ID NO: 4360 - DNA, 1727 bp, Rattus norvegicus
  Genbank Accession No. U09361
agaaaggcagacacaagagcaagcctgcacgtgtgaaggcatccacagaagaagtaccttctctggaaaatctcaccgtgactgaggccggctgggatggcctcagactcaactggactgcagatgacctggcctatgagtactttgttattcaggtacaggaagccaacaaggtggagactgctcacaacttcacagtacttggtaacctccggactgcagacatcccgggcctcaaggctgccactccttatagagtttccatttatggggtagctcggggctataaaacacccgtgctctctgctgagaccttcacagggaaaactcccagtttgggagaggtgactgtggctgaggtgggctgggatgccctcaagctcaactggactgctccagaaggagcctatacgaactttttcattcaggtgctagaggctgacatgacccagactgtccagaacctcacagtcccaggaggactcaggtcagtggacctacctgggctcaaagcagccacccgctattacatcaccgttcgaggggtcacccaggacttcagcacagcccctctctctgttgaggtcttgacagaggagatccctcaactgggaggcttgtccgtgactgaggtcagctgggacagccttacactcaactggaccacagatgatctggcctataagcactttatcattcaggtgcaggaggccaacaatgtagaggctgctcagaacctcacagtatctggtagcctcagagttgtggacatcccaggcctcaaggctgataccccttatagagtctccatctatggggtgatccagggctatagaacaccaatgctctctgctgatgtctccacagccaaagaacctgaaattggaaacttaaatatttctgatgtaactcctgagagcttcaatctctcctggacagctaccgacgggatcttcgacatgtttactatcgaaattattgattctaataggttgctgcagacagcagaacataatatatctggtgctgaacgaactgcccacatctcgggccttccacctagtactgatttcattgtctacctctctggaattgctcccagcatccgtaccaaaaccatcagtaccacagccaccacagaagctgaaccggaagttgacaaccttctagtttcagatgctactccagacggtttccgtctgtcctggactgctgatgaagggatattcgacagttttgttatcaggatcagagataccaaaaagcaatctgaaccacaagaaataaccctcccttcccccgaccgtaccagggacataacaggtctcagagaggccactgagtacgaaattgaactctatggaataagccgtggaaggcgatcccagccagtcagtgccatagcaacaacagccatgggctctccgaaggaaatcatgttctcagacatcactgaaaatgcagccacagtcagctggagggcaccgactgctcaagtggagaatttccggattacttatgtgcctgtaacaggaggtcccccatccatggtgaccgtggatgggacggatactgagacccgactggtgaggctcacccctggagtggagtaccacgtcagtgtgattgccatgaagggatttgaagaaagtgatccggtctcggggtctctaatcacagctctcgatggtccatctggccttctgacagccaacagcacggactca

SEQ ID NO: 4361 - DNA, 2226 bp, Rattus norvegicus
  Genbank Accession No. U10188
gccgcgtttgatttcggggaggagcggagcagagcaggacccctctgcacccactcagccgactcagccaggttcgtggagcaacttcggcatcatgaatgcagcggccaaagctggaaagctggctcgagcaccagccgacctcgggaaaggtggggttccgggagatgcagttcccggtgccccagtggccgccccgctggcgaaagaaattccggaggtcctagtggacccacgcagccggcagcagtatgtacggggccgcttcctgggtaaaggaggcttcgccaaatgcttcgaaatctcagactcagacacaaaagaggtgttcccaggcaagatcgtgcctaagtctttgctgctcaagccccatcagaaggagaaaatgtctatggagacctccattcaccgcagcctcgaacaccagcacgtcgtaggcttccatggcttttttgaggacagcgactttgtgttcgtggttttggagctctgtcgcaggaggtctctcctggagctgcacaaaaggaggaaggcgctgaccgagcccgaggcccgatactacctgcggcagatagtcctgggttgccagtacctgcaccgcaatcaagtcattcacagggacctcaaactgggcaacctctttctgaatgaggatctggaggtgaaaataggggattttggcctggcaacaaaagtggaatatgaaggggaacggaagaagaccctgtgtggcactcctaactacatagctcccgaggtgctgagcaagaagggacacagctttgaggtggacgtgtggtccattgggtgcatcatgtataccttgctggtgggcaagccaccttttgagacctcatgcctaaaagagacctacctccggatcaagaaaaatgaatacagtattcccaagcacatcaacccagtggctgcctccctcatccagaaaatgcttcagacagaccccgctgcgcgccccaccattcacgagttgctcaatgacgagttcttcacttccggatacatccccgcccgtctgcctattacctgcctcaccatcccaccaaggttttcaatagctcccagcagcctagaccccagcaacaggaagcctctcacagtccttaataaaggtgtggagaaccccctgcctgaccgtccccgagagaaagaggaaccagtggttcgggagacaaatgaggccatcgagtgccaccttagtgacttgctacagcagctgaccagtgtcaacgcctccaagccctcagagcgagggctggtgcggcaagaggaggccgaggatcctgcttgcatccctatcttctgggtcagcaaatgggtagactattcggacaagtatggccttggttatcagctatgtgacaacagtgtgggagtgctctttaatgactcaacacgcctcatcctctacaatgacggggacagcctgcagtacatagagcgtgatggcacggagtcctacctcactgtgagctcccaccccaactccttgatgaagaagatcactctcctcaactatttccgcaattacatgagtgaacacctgctgaaggcgggggccaacatcacgccccgggaaggcgacgagctggcccggctgccctacctacgaacatggttccgcacacgcagcgccatcatcctgcacctcagcaatggcacagtacagattaatttcttccaggaccacaccaaacttatccgtggccccctgatggcagcagtgacctacatcaacgagaagagggacttccggacataccgcctgagccttctggaggaatatggctgctgcaaggaactggctagccgcctccgctatgcccgcaccatggtagacaagctgctgagctcgcgttccgcctgcaaccgcctcaaggcctcctaggtctccgtccttcggactggtgccccttcattctgctagctctctgctagctctgggcctgcactactgggctcctggggccgctgttcagtgccctggccctggggctggcagggagcagtgcccctgtgaagggttgctgtgtgtaagttattttgtacatgattgggtgtggtttgcagcctgttccctgcccttggcccactgtatgaactgtataaatatttctattgaatttgggactgccctttccttagctttatatatattaaatatttgtacatctctctctaaaaaaaaaaaaaaagggcggccgctct

SEQ ID NO: 4362 - DNA, 1885 bp, Rattus norvegicus
  Genbank Accession No. U10697
cgtgtccatgcaagatgtgcctcagcttcctgttcctggtgtccctagcaacctgtgtggtttatggaaacccctcttcaccacccgtggtggacaccacgaaaggcaaagtcctggggaagtacgtcagcttagaaggagtcacacagtctgtagctgtcttcctgggagtcccttttgccaagccccctcctggatctctgaggtttgctccaccacagcctgcagagccctggagcttcgtgaagaacaccaccacctatccacctatgtgctctcaagatgcagcaaaagggcagaggatgaatgatctcctaaccaacagaaaggagaaaatccatctcgagttttctgaagattgtctctacctgaatatttacactcctgcagactttacaaagaatagcaggctgccagtcatggtgtggatccatggaggtggaatgacactgggcggggcatcaacctatgatggccgggtcctctctgcctatgaaaacgtggtggtagtggccattcagtatcgcctgggcatctggggattcttcagcacaggggatgaacacagcaggggaaactggggtcatttggaccaagtggctgcgctgcactgggtccaggacaacattgccaactttgggggtgacccagcgtctgtgaccatctttggagagtcagcaggaggtttcagtgtctctgttcttgtgttgtccccactgaccaagaacctcttccacagggccatttctgagagtggggtggtcttccttactggattgttaaccaaggatgttagaccagccgctaagcaaattgctgatatggctggatgtgaaaccaccacatctgccatcattgttcactgcctgcgtcaaaagacagaagaggagctcttagagatcatgaagaaaatgaatctgattaaactcagttcacaaaggataacaaaagagagctaccactttttgtcaactgtggttgacaatgtagtgctgccgaaggacccaaaagagatcctggctgagaagaacttcaataacgtgccctacattgtgggaatcaacaagcaagaatgtggctggcttctgccaacaatgatgggatttgtaccagctgatgtagaattggacaagaagatggccattacgctcctggagaaatttgcttccctatatggtataccagaggatattattccagttgccattgagaagtacagaaaaggtagtgatgactccatcaagatcagagatggaatccttgcctttattggggatgtgtcatttttctatccatcagtgatggtgtcccgtgaccacagagatgctggagctcccacctacatgtatgagtatcaatactacccgagcttctcatcaccccaaagacccaagcatgtagtaggagaccatgcagatgatctctactctgtctttggtgccccaattttaagagatggtgcctcagaagaggagatcaagctcagcaagatggtgatgaaattttgggccaactttgctcggaatgggaaccctaatgcgcgagggctacctcattggccacagtatgaccagaaagaagaatatctgcagattggtgccaccacccagcaatcgcagagactgaaagcagaggaagtggctttttggacacagttactggctaagagagaacctcagccccaccacaacgagctgtgaatgcaagtctctgtcagcttcagaacaagcaagccaagatattgttcttccagtaaagatgtttgtaaatgaaagatggatctggaggatcctgaagaattttgtaatagagacagggagaacccaggaaagagaaatatttgtacttggcatcaatttagagaataaatgacattttcaggtca

SEQ ID NO: 4363 - DNA, 1812 bp, Rattus norvegicus
  Genbank Accession No. U17565
ctcagagatgaggagcagacagctgagagcattaagaaccaaatgacggtgaaggaatgggaaaaggtgtttgaaatgagtcaggaccaaaacctgtaccacaatctctgcactagcctcttccctacgatccacggcaatgatgaagtaaaacgtggcgtcttgctgatgctgttcggtggcgttcccaagacaacaggggaaggaacctctcttcgtggggatataaatgtttgcattgttggggatccaagtacagctaagagccagtttctcaagcatgtggatgagttcagtcccagagctgtgtataccagtggcaaggcctccagtgcttccggcttgacagcagctgtggtgagagatgaggaatctcacgagtttgtcatcgaggctggagcgttgatgctggctgataacggtgtctgttgcattgatgagtttgataagatggacatgcgggaccaagttgctattcacgaagctatggagcagcagaccatatctatcactaaagccggagtgaaggcaactctgaatgccaggacatccattttagctgcagcaaaccctgtcagcggacactacgacaggtcaaaatctctgaaacagaacatcaatctgtcagcgcccatcatgtcccgctttgacctcttcttcattttggtggatgagtgcaatgaggtgacagattatgctattgccaggcgcatagtagacttgcattcgaggatcgaagaatcgatagaccgggtttattcccttgatgatataagaaggtatcttctcttcgcccgacagtttaagcccaagatttccaaagagtcagaggacttcattgtggagcagtacaaacgcctccgccagagggatggctctgggatcaccaagtcgtcgtggagaatcactgtgagacagcttgagagcatgatccgactctcagaatcgatggcccgcatgcactgctgtgatgaggtccagcctaaacatgtgaaggaagcttttcgattactgaataaatcgatcatccgtgtagaaacgcctgacgtcaatctagatcaagaggaagagatccagatggagacggatgagggaccaggaggcatcaatggtcatgctgacagccctgcccctgtgaacgggttcaatggctctggtgaagatgccagtcaggagaccgttcccaagccctcccttaggttggcctttgctgaatactgccgaatctctaacctcatcgtgcttcacctcaggaaaatggaagaagaggaggatgagtcagccctaaagaggagcgagctggtcaactggtacctgaaggaaatcgagtcggaaatcgactctgaagaagagctcataaataagaagaggatcatagagaaggttgttcatcgtctcacacactacgatcacgttctgattgagctcacccaggctggactgaaaggctccagtgaaggaagcgagagctatgaggaagatccttacctggtagtcaacccgaactacttgcttgaagattgagatatagaaggtgacttacggccaggaaccgggggtggcctaccttagccgggacctgggcatgcactgagaccgtttctggagcgatgcttgggggacagttgagaagagacagctgaacagtgagtaatgccgtgatttcatgctggacatgcgtgggtactttgtgcttttcctacacatgaaataaaaagtatttcagaaaacatgattgggatccaacttcaacaggacaagacaaagtgcccacgcatgtgccagcattaaatccacggccatgaactcagc

SEQ ID NO: 4364 - DNA, 6152 bp, Rattus norvegicus
  Genbank Accession No. U17837
gccaagatggcggcggcgcggccgcgggcgccagggcgacggcggcggctgaggctctgggctcgctgaagcgttggcacgtcgcgctctgggctcatgtaatcaaagaagtttctttgttgtgtgtatcttcacagaacacaacaggaattgaaaatgcatcagaacactgagtctgtggcagccactgagactctggctgaggtacctgaacatgtgcttcgaggacttccagaggaagtaagacttttcccatctgcagtcgacaagactcggattggtgtctgggctactaaaccaattttaaaagggaaaaagtttgggccatttgttggtgataagaagaagagatcccaggttaggaataatgtgtacatgtgggaggtctactacccaaatttggggtggatgtgcattgatgccaccgatccggagaagggcaactggctacgctatgtgaactgggcttgctcaggagaagagcagaatttatttccactggaaatcaacagagccatttactataaaaccttaaagccaatcgcgcctggcgaggagctcctggtctggtacaatggggaagacaaccctgagatagcagctgcgattgaggaagagcgagccagcgcccggagcaagcggagctccccgaagagccgcagagggaagaagaaatcacacgagaacaaaaacaaaggcatcagaacccaccccacacagctgaaggcaagtgagctggactctacctttgcaaacatgaggggctctgcagaaggtccaaaagaagaggatgagaggcctttggcttcggcacctgagcagccagcccctctgccggaggtggggaaccaagatgcagttccacaggtggccatccctctccctgcctgcgagccacagccagaggtagatgggaaacaagaagtcacagactgtgaggtcaatgatgtggaggaagaggagctggaagaggaagaggagctggaagaggaggaggaggaggagttgggagaagatggggtagaagaagcagacatgccgaatgaaagctctgcgaaagagccggagatccggtgtgaagaaaagccagaagacttattagaagagccacagagcatgtcgaatgaagctcgtgaagactctccagacgtgacccctcctccccacactcccagagctagagaggaggccaacggtgatgtacttgagacatttatgtttccgtgtcagcactgtgaaagaaaatttgcaacgaagcaggggctagagcgtcacatgcacatccacatttctaccatcaatcatgctttcaagtgcaagtactgtgggaaacggtttggcacacagattaacaggaggcggcatgaacggcgccacgaaacggggttgaagagaagacccagcatgactttacagtcctcagaggatccagatgatggcaagggggaaaatgttacttctaaagatgagtcaagtccacctcaactcgggcaagactgtttgatattgaactcagagaaaacctcacaggaagtactgaattcatcttttgtggaagaaaatggtgaagttaaagaacttcatccgtgcaaatactgcaaaaaggtatttggaactcacaccaatatgagacgacatcagcgtagagttcatgagcgccacctgattcccaaaggtgtcaggcgaaaaggaggacttctggaagagccacagccaccagcagagcaggctccaccctcccagaatgtctatgtcccaagcacagagccagaggaggaaggggaaacagatgacgtgtacatcatggacatttctagcaacatctctgaaaacctaaattactatattgacggtaagattcagaccaacagcagcactagtaactgtgatgtgattgagatggagtctaattctgcacacttgtatggcatagactgtctgctcactccagtgaccgtggagattactcagaacataaagagcactcaggtctctgtgacagatgatcttctcaaagactctcccagcagcacaaattgtgagtctaagaaacggaggactgccagtccacctgtgctccccaaaattaaaacggagacggagtctgattccacagcaccctcgtgttccttaagtctgcccctgagcatatccacagccgaggtggtgtccttccataaagagaagggcgtctatttgtcgtccaagctcaagcagcttcttcagacccaggacaagctgacccttcctgcagggttttcagcagctgagattcctaagttaggtcccgtgtgcgcgtctgctcctgcatccatgttgcccgtgacctctagtaggtttaagagacgcaccagctctccaccgagctctccacagcacagccctgcccttcgagacttcgggaaaccaaatgatgggaaagcagcatggacagacacagtcctgacttccaagaaacccaagttagaaagtcgtagtgactcaccagcatggagtttgtctgggagagatgaaagagaaaccggaagccctccttgctttgatgaatacaaaatatcaaaggaatgggcagccagttctactttcagcagtgtgtgcaaccaacagccattggatttatccagcggggtcaaacagaagtcagagggcacaggcaagactccagtcccatgggaatctgtattggatctcagtgtgcataaaaagccttgcgattctgaaggcaaggaattcaaagagaaccatttggcacagccagctgcaaagaagaaaaaaccaaccacctgtatgcttcaaaaggttcttctcaatgagtataatggtgttagcttacctacagaaaccacaccagaggtgaccaggagcccaagtccttgtaaatccccagatacacagccagatcctgaacttggtcctgactcaagttgctcagtccccactgctgagtctccacctgaagttgttggcccttcctcaccccctctccagacagcctccttatcctccggtcagctgcctcctctcttaacccccacagagccttcttcccctcccccctgccctcctgtgttaactgttgccactccaccacctcccctccttccaaccgtccctctctcccacccctcttctgatgcctcccctcagcagtgtccctctccgttctcaaacaccactgctcagtctcctcttcccattctctccccaacagtgtctccctctccctctcccattcctcctgtagagccacttatgtctgctgcttcccctggtcccccaacactttcttcctcctcctcttcttcctcttccttcccttcctcttcctgctcctccacctccccctccccaccccctctttcagcagtgtcatctgtggtttcctctggggacaacctggaggcatctctgcctgcagtaactttcaaacaggaggagtcagagagtgaaggtctgaaacccaaggaagaggccccacctgcagggggacagagtgtggtccaagaaacattcagcaaaaacttcatttgcaatgtctgtgaatcgccttttctttccattaaagacctaaccaaacatttatccgtccatgctgaagagtggcccttcaaatgtgagttttgtgtgcagctgtttaaggttaagactgatctatcagagcatcgatttctgcttcatggggttggaaatatctttgtgtgttctgtatgtaagaaagaatttgccttcttatgcaatctgcagcagcaccagcgtgatctccacccagatgaggtatgcacacaccacgagtttgaaagtgggaccctgaggccccagaacttcacagaccccagcaaggccaatgttgagcatatgccaagtttgccagaagagcctttagaaacttctagagaggaggagttaaatgattcctctgaagagctttacacgaccatcaaaataatggcttctggaataaagacgaaggatccagatgttcgacttggtctcaaccagcactacccgagctttaaacctcctccatttcagtaccaccatcgaaaccctatggggataggggtgacagccaccaacttcaccacccacaatattccacagactttcactactgccatccgctgcacaaagtgtgggaagggcgtcgacaatatgcctgagctgcataagcatatcttggcgtgtgcgtctgcaagtgacaagaagaggtacacccctaagaaaaacccagtgcccctgaaacaaactgtgcagcccaaaaatggagtggtggttctagacaactctgggaaaaatgccttcagacggatggggcagcccaagagactgagcttcaatgttgaactgggtaaaatgtctccaaacaagctcaagctgagtgcgctgaagaagaaaaaccagctggtgcagaaggccatccttcagaagaacagagccgcgaagcagaaggcggacctgagggatacttccgaggcgtcctcacacatctgcccgtactgtgacagggagttcacatacattggcagcctgaataagcatgccgccttcagctgtcctaaaaaacctctttctccttccaaaagaaaagtttcccattcgtctaagaaaggtggccatgcatcatcttctagcagtgacagaaacagcagctgccacccccggaggcggactgcagataccgagatcaagatgcagagcacgcaggcacccttgggcaagaccagagctcggagtacaggccccgcccaggcctcactgccctcctcgtccttcagatccagacagaatgtcaaatttgcagcttcagtgaaatccaaaaaagcaagctcttcatccttgaggaattccagtcccataagaatggccaaaattactcacgtcgagggcaaaaaacccaaagctgttgccaagagtcattctgctcagctctcaagcaaatcctcccgaggcctgcatgtcagagtgcagaagagcaaagctgtcatacagagcaagactgccctggccagtaagaggagaacagaccggttcatagtgaaatctagagagcgcagcgggggcccaatcacccgaagccttcagctggcagctgctgcggacctgagtgaaagcaggagagaggacagcagtgccaggcatgagctgaaggacttcagctacagtctccgcctggcatctcgatgcggctcatcaacagcctcttacatcaccagacaatgcagaaaggtcaaggccgccgcagcaactccgttccagggacccttcctcaaagagtaggcactctgtctgctccttaacagcacctgaagtgacctggaatcagtgaagccaaagggaccagcagtctgccctgcagagagcactgacctctcccagttgtgagagtgagagaacgagagagagagagagagagagagagagagagagagagagagagaatgagaatgtgtgtgtgtgtgtgctggtgcatgtgtgtggtcttcaagccaaggtcccagcctcaggagcaggaccttcccatttcccgtcatcctctggatgatccttggacgtggcccagaaccgtgctctgtggtgcagccatcctgcccgggaggggcatctccttctatgcaatttttttaaagagttccttggccctgctttgtgcttcttgagctgtccgtttgccaccactgggacttggatctggccctgaggggtggggaagagggcctatctaaggataacctttcagaggtcaagctccccttcatgccacccctcccccctgccctcaccgaccttttccccacactgtctctgggaatcaatagcagatagcatatagatccatcagggttgagcctgaacctcggccctagcactaggaaatcccccttttctccctaagcaactggagccgccagctttcaagtcatttcctcctttgaggttctagagtccgagagtctgctccgaagtctctcctgggaacccgggagccctcgcacccaggacgcagactctgtgcccattcttagacctgaggtagaagaagcagtgttttgggacgatagggtggaggcgtgcctactttgtctcctctggtgggacctcctacatcattggcatctgaaccttgcaagttcgctgcaaagagaagcaaagga

SEQ ID NO: 4365 - DNA, 660 bp, Rattus norvegicus
  Genbank Accession No. U19485
ttcccggtgtatgactatgacccttcctctctgcaagaagctctcagtgcctcagtggctaaggtgaactcgcaatccctgagtccttacctgtttcgggcgacgcggagctccctgaagagagttaatgtcctggatgaagacacactggtcatgaacttagagttcaccgttcaggaaactacatgcctaagagagtctggtgatccctccacctgcgccttccaaaggggctactctgtgccaacagctgcttgcaggagcacagtgcagatgtccaagggacaggtgaaggatgtgtgggctcactgccgctggcgttccacatccgagtccaacagcagtgaggagatgatttttggggacatggcaagatcccaccgacgaagaaatgattatctacttggctttctttatgatgaacccaaaggagagcagttctatgaccggtcgattgagatcacgaggaggggacatcctcctgcccatagaaggttcctgaacctccaacgcagagccagagtcaattctggctttgagtgacatcctggagattccatgaaagaaagagaagcagaagctgaaatgaaggacatggagaattgtgtctttttcctttgataagctccactttgcaataaagatcttccccttcctgta

SEQ ID NO: 4366 - DNA, 599 bp, Rattus norvegicus
  Genbank Accession No. U20194
ggaaaggggagatgctgtgcagtacatcccagccatcatcaagtctaaggctgagcccctgtatgaacttgtgacagccacagactttgcgtactccagcacagtgaaacagaacatgaagaaggccctagaagaattccagaaggaggtcagctcctgccgctgtgctccgtgcaggaacaatggagtccccatcctgaaagaatcccgctgtgagtgcatctgtcctgtcggtcttcaaggtgtagcctgtgaggttaccaatcggaaagatatccccatagatgggaagtggagttgctggtctgactggtctccatgctctggaggacgcaaaacaagacaaaggcagtgcaacaacccggcacctcagagaggaggcagcccctgctcaggtcctgcttcagaaacactcaactgttaaagggagggaacacagccggcaggtgatcatcagggctctaaccctctcacacttagccaggctttagcacaccagctcccacccagggctaccacaacaaaaagcaatgccactctgccctttaaaggtttagtttcttcagtgcatgttaattccagtaaacagtgggtggagc

SEQ ID NO: 4367 - DNA, 643 bp, Rattus norvegicus
  Genbank Accession No. U26310
aacccccatgctagctgccaccattgttcacttcaaggtctctgcccaaggaatcacactgactgacaatcaaagaaagctcttcttcagacgacattaccccctcaacactgtcaccttctgtgacctggatccacaagaaaggaagtggatgaagacagagggaggtgcccctgctaagctcttcggcttcgtggcccggaagcagggcagcaccacagacaacgcttgccacctcttcgcagagcttgaccccaaccagcctgcgtctgccattgtcaacttcgtctccaaggtcatgctgagtgctggccaaaagagatgaacgaatcctggagcccttgcccaaggctggggcactggggacggggtgtgtggggagggatctgcgaatcctgaccaccttgaatccagaacgagggctttgggtcgaccgtggagaaggagagaagaaagtgcaatgctgggagagggaagtgaattgtggagggagggaggggaacaggaggaagaggaaggaaggaagaagagaggaactcgaaatcccctgtacagatggaagccacacctcccaaagcctctccagctagctggggcccctccccctcacctcccaaagcctctccagctagcatgggggttc

SEQ ID NO: 4368 - DNA, 1947 bp, Rattus norvegicus
  Genbank Accession No. U27518
ggcacgagaggactttgatcttcaggatgcctcagaagtggatttctgctctgctcctactgcagataagtttctgcttcagatctgggaactgtgggaaagtgttggtgtggccattggaatacagtcactggatgaatttaaagataatactggatgaacttgtacagaggggacatgaagtcactgttctcagaccttcatcttccgtctctcttgatcccaaaaaagcatctggtcttgtatatgaaacatctcctacaacttccaataatgatgaagtagaaaagtctttttacccagtgggtgatatgtggacatacgatgtgccaaaatatacatgtttgagatactacccatctttgaacaaaatgttcgggcaattttctgatttgtggttacagctttgtagagaagttgtttcaaacaaggaacttatagcaaaactaaaggaatcccagtttgatgtggttctttcagatgctgttggtccctgtggtgagctgatagctgagatactgcagttaccatttgtgtacagtcttcgctttgccaccgcccctggaatagaaaagtacagtgcaggacaacccttccctccctcttatgtacctattattttgtcaggatttagtggtcaaatgacattcatggagagagtggaaaatatgctatgtttactttattttgattcctggttcgagtcatttcctgctaaggattgggatccatttttcagcgaaattttaggaagacccactacaatggttgacacaatgaagaaagcagaaatatggctcattcggtcctactgggacttggagtttccccgcccatccttgccaaacattgagtttgttggaggacttcactgccaacctgccaaaccattacctaaggaaatggaagactttgcacagagctcaggagaacatggtgtgtgggtgttttctctggggtcgatgatcaggaacataacacaagaaagggctaacacaattgcatcagccctggcacaaattccacaaaaggttttttggagatttgagggcaagaaaccagacaccttaggacccaatactcgggtgttcaagtggataccccagaatgaccttcttggtcatccaaaaactaaggcttttgtaactcatggtggagccaatggcatctatgagtcaatccattatgggatcccccccatggttggcatccctttatttgcagaacaacgtgataacgttgctcacatggtagccaaaggagcagctgtttctatagattttcatacaatgtccagttcagatttgctcaacgcactgaaggcagtcatcaataacccctcctataaaaagaaagtgatgtggttgtcagccattcaccatgaccagcctctgaagcctctggacagagcagtcttctggattgagtttgtcatgcgtcacaaaggggccaagcatctgagaccacttgcacataaccttgccctggtatcagtacactctctggatgtgattggattcctgcttgcctgtgtgctggccattgttttacttgctgtaaaatgctgtctgtttctttaccgattttttgtaaaggtggcaaagaataaaagggactagggttctttaagaaggaaggctgtgatctgtggtcgtgatgggcatgactactccctttattgctggaactatatatcagatgctccttgttttagaagacattgagctaattgatttatctatagatgtcacactataggttaagaaagtaaccgttttaaatctttattttctcaaatccaccgttttcatattgattctcgatgtgatagtgctgaggataatgataatccctgaaacaccaacttgcttatgggcaaagatataggaagcctaaactttttactgtgaattttcagatatttataaaataaaattgaataaaatt

SEQ ID NO: 4369 - DNA, 573 bp, Rattus norvegicus
  Genbank Accession No. U31598
gtgcttgaagcttctccccaggcgtggtgggatgagtcgcagaaccacacattccgtcacactctgttctgccaggatgggtttcccaacatagggctctccgagacctacgacgaggacgcactcttctccttcgacttctcccagaacaccagagtgccccggctgcctgagtttgctgagtgggctcaggaacagggagatgcctctgccattgcgtttgacaaaggcttctgcgacatgttgatgcagaatgtgagcccgcggcttgaaggtcaaatcccagtgtccagaggtttgccttcggctgaggtgttcaccctgaagcccctggagtttggcaagcccaacacgctggtctgtttcatcagcaacctctttccaccgactttgacggtgacctggcagcatcatttcgtccccgtggagggagccagccccacatccgtttcagccatcgatgggctcaccttccaggccttctcttatttaaacttcacaccggaacccttcgacctttactcctgcactgtgacgcacgagattgaccgctacacggcgattgcctattgg

SEQ ID NO: 4370 - DNA, 1496 bp, Rattus norvegicus
  Genbank Accession No. U31668
gcgggggcagcagcaggcacgagaagagcctggggttgctcaccaccaagttcgtgtcgttgctgcaggaggcgcaggacggcgtcctggatctcaaagcggctgcagatactttggctgtgaggcaaaagcgaagaatttatgatatcaccaacgtcttagaaggaattgatctaattgaaaaaaaatcaaagaacagtatccagtggaagggtgtaggtgctggctgtaatactaaagaagttatagatagattaagatgtcttaaagctgaaattgaagatctagaattgaaggaaagagaacttgaccagcagaagttgtggctacagcaaagcatcaaaaacgtgatggaagactccattaataacagattttcttatgtaactcacgaagacatctgcagttgctttaatggtgatacactgttggccattcaggcaccctctggtacacagctggaagtacctattccagaaatgggacagaatggacaaaagaaataccagataaatctgaagagtcactcaggaccaatccatgtgctacttataaataaagagtccaactcatctaagccggtggtttttcctgtccccccacctgatgacctcacacaaccttcctcccagtcctcaacttcagtgactccaccgaaatccaccatggctgctcaaaacctgcccgagcagcatgtttctgaaagaagccagaatttccagcagacaccagctacagaaatatcttcaggatctattagtggagacatcattgatgaactgatgtcttctgacgtgtttcctctcttacggctgtctcctaccccagcagatgactacaactttaatttagatgataatgaaggagtttgtgatctgtttgatgttcagatactaaattattagattccacggaaacttgggactgttatctacctctaactgtaacattttagaattcttaataacctaagtatttaaaattatgaatgtaacacctttttagttcactgactctaaagtgttttcctaacattttacttttacttcacaaaacttgaaagggctctgactgcttcagggggggataattaactgtccaccagcatgcccctccagtgattacactcagtttcattcagtgctgaattctgtagcttcttcttagaggacagttacagcaggcttcagttcatcataacaaaacattgtccaaaagatcacttacttgtcttatgtttttactgccaaagctgtttctatgtatccttcaaacagacattcactgccatatataaagtgaaggatatcactgttgagtgaacagattttgtgaagtgccttctgttttagcactttaagtctatcagtttgttgattcagacactccactttcctagagtataggaaagatctgtttatgtagtttgtttttaaaatgtgccaatgcctgtacattaacaagatttaaagaaataaagttgtatgaaacattga

SEQ ID NO: 4371 - DNA, 2265 bp, Rattus norvegicus
  Genbank Accession No. U32575
atgtgcaaagattctgcctgcttttcgactatgaaggagacagacctggaggctgttgcaacagcagtccaaagggtggctgggatgcttcagcgcccagaccagctggacaaagtggagcagtatcgcagaagggaggctcggaagaaggcctctgtggaggccaggctaaaggccgcaatccagtctcaactagatggcgtccgcacaggcctaagccaactgcacaatgcactgaatgatgtcaaggatatccagcagtcactggctgatgtgagcaaggactggaggcagagcatcaacaccatcgagagtctcaaggacgtaaaagacgcagtggtgcagcacagccagctggctgcagctgtggagaacctcaagaacatattctctgtgcctgagattgtgagggagacccaagatctcatcgagcaaggggctctcctgcaggcccaccggaagctaatggatctggagtgctcccgggatgggctaatgtgtgagcagtaccgcatggacagtgggaacaaacgggacatgaccctcattcatggctacttcggtagcacacaggggctctctgacgagctggccaagcagctgtggatggtgctgcaaagatcgctggtcactgtccgccgggatcccaccttgctggtctccgtggtcaggatcattgaaagggaagaaaaaattgacaggcggatacttgatcgaaaaaagcaaactgggtttgttcctcctggaaggcccaaaaactggaaggaaaaaatgtttgccgtcttggacagaactgtgacgactagaatcgaaggcacgcaggcggacaccagagaatctgacaagatgtggctcgtgcgccacctggagatcattaggaagtacgtcctggatgacctcgtcatcgccaagaacctgctggtgcagtgcttccctcctcactatgacatctttaagaacctcctgagcatgtaccaccaggccttgagcattcggatgcaggacctcgcctcagaggaccttgaggccaacgagattgtgagcctcttgacctgggtcctaaatacctacaccagtgcagagatgatggggaatgtggagctggccccagaggtggacgttaatgccctggaaccgctcctctcaccaaacgtggtctctgagctgctcgacacatacatgtcaacactcacgtccaacatcattgcctggcttcggaaagcactggagacagacaagaaagactggagcaaagagacggagccggaagcagaccaggacggctattatcagacgacacttcctgccattgtattccagatgtttgaacagaatcttcaagttgctgctcaaataagtgaagatttgaaaacaaaggtattagttttgtgtcttcagcaaatgaattctttcctaagtagatacaaagaggaagcccagctttacaaagaggagcacctgagaaaccggcagcacccacactgttacgtgcagtacatggtcgccatcatcaataactgccagaccttcaaagaatccatcatcagtctgaaaagaaaatacctaaaacccgaaacagaggaaagcctgtgtcagagtcagcccagcatggatgggattctagatgccattgctaaggaaggctgcagcagtctgctagaggaggtcttcctggatctagagcaacatctgaatgagctaatgacaaagaagtggatgttaggatcaaatgctgtggacatcatctgtgtcaccgtagaagactacttcaatgacttcgccaaaattaaaaagccatacaaaaagaggatgacagctgaggcacacaggcgtgtggtggtggaatacctgcgggctgtcatgcagaagcgtatttcctttcggagtgctgaagagcgcaaggagggtgctgagaagatggtcagagaggcggaacagctccgcttcctgttccggaagctggcatctggatttggtgaggatgcagatggacactgtgacacaatcgttgcagtggcagaggtcattaagctcacggacccgtctctgctctacctagaagtctcaactctggtcagcaaatatccagacatcagagatgaccatattggtgcgctgctggcactgcgaggagacgccagccgggacatgaagcagaccatcatggagacactggagcagggccccatgcaagcgagccccaactatgtgcccatcttccaggagattgtggtgcccagtctgaacgtggcaaagctccttaag

SEQ ID NO: 4372 - DNA, 1998 bp, Rattus norvegicus
  Genbank Accession No. U33500
ggtgctgctgctgcatgtctgactgagaagggagccgagcatctgaggagcaagacatcagaaggctggagtcccttccctgactaggccagagctaaaaggacaaggctcagggctagcctctgcctatctagttcttttctccctgaagcttacaccatcctgtgggagccgatgcccgtctcattttgactcagagtctgtccctctgcttgtcttctacaaaccatgtggctgtacctgctggcactggtgggcctgtggaacctcctgcgcttgttcagggagaggaaggtggtaagccatctccaagacaaatatgtcttcatcacgggctgtgactcaggctttgggaacctgctggccagacagctggacaggagaggcatgagggtgctggctgcatgtctgactgagaagggagccgagcagctgaggagcaagacatcggacaggctggagacagtgatccttgatgtcaccaagacagagagtattgtggcagccactcagtgggtgaaggagcgagttgggaacacaggactctggggcctggtcaacaatgctggcatctccggccacctgggtcccaatgagtggatgaacaaacagaacattgcaagtgtgctggatgtgaacctgttgggcatgatcgaggtgactctgagcacggtgcccttagtgaggaaggcgaggggccgtgtggtcaacgttgccagcatcgcaggccgactgtctttttgtggtggtggttactgcatctccaagtatggtgtagaggccttctcagactccctcaggagagagctctcctattttggggtcaaggtggctattgtagagcctggcttcttcaggactgatgtgaccaatggtgtcacattatcatcaaacttccagatgctgtgggaccagaccagctcagaagtcagggaagtctatggcgagaactacctggcatcttatctgaaaatgctaaatggattggaccagaggtgcaacaaagatctgtctctggtgactgactgcatggagcacgccctgacttcctgtcaccctcgcacccggtactcagctggttgggatgccaagttcttctacctccccatgagctatctgcccacctttcttgtggatgcccttttctactggacttctccaaagcctgagaaagctctctgaagtctttacctatgtacataactgaggagatgttggtacagtgttagggaggggatcctgaggaggaggtcggagtgctgaggagggagggaggtcattcctctggggtttagtccacactcttcattttgctaattttcctgtgctactactcaaggctgactcgactgacccaagaaatagccaaagaattctgcgaagaagttcaaatacaaaagtgctggcagttgcctagcctctgggcaccatgacctaccatggcgatccacacaaatggggagtttgagaccagcttgtaccaaacactgccctgggtccccctgtgcaggaagtgcacatgccctggctagtttgtaccctatgcagcatagaagtgtccctgctctgaagtcacctgtgaccctggtgtcaggtttgagaagaatcactaataattctaacactcatgcttgaaggccaggtcgcagcctgggtgggagagtcggttacttgtggtgagaatatagtagaggatagagacattaattttttttaaatttactttgaagtcatggctcttcttttcttttttggagtcttttcctttttagagcatagcatgaggtgacctcttgttccctgtgatttaaacaatggcattgctggttggtgaggtttggattgcaggggtaaggggaatgtcctgagaagggtgtgcataggccagcaggaatttccttgcccgtctcagcccttctagccactgaggtgggaataactgctgtccattcaaaacttaacaacaacccctaaggcataagagcatgcatgcaggcc

SEQ ID NO: 4373 - DNA, 1683 bp, Rattus norvegicus
  Genbank Accession No. U34843
gtcgaccaattcggcacgagggacagggcagcgattgacgcggcagctggaggatgaagaaggagcatgttagtcactgtcagttctccgcgtggtacccactcttccgaagccttaccatcaagagtgtcatcctcccgcttcctcagaatgtgaaagactatttacttgacgacgggactctggtggtctcaggaagggaagacccaccaacatgctctcagccagacagtggtgacgaagcagaggaaacacagtggtccgatgatgagagcacagccacacttacggcacccgagtttcctgagttcaatactcaagtccaagaagctatcaattcgctggggggcagtgtcttccctaagcttaactggagtgccccaagggatgcatactggatagcaatgaacagttctctgaagtgtaaaagcctcagtgacatcttcctgcttttcaagagttcggacttcatcactcatgacttcacacagccgtttattcattgtaatgatgattctccagatccttgtatagagtacgagcttgttctccgaaaatggtgtgaattaatccctggggctgagttccgatgttttgtcaaggaaaacaagcttattggtatttctcagagggactacacgcagtactatgatcatatctctaagcaaaaagaagaaatttgcagatgcattcaagactttttcaaggaacacctgcagtacaaattcttagatgaagactttgtgtttgatatatacagagacagtaggggcaaggtgtggctgatcgactttaacccatttggggaggtcacagactctctgctgtttacttgggaagagctgacatcggagaacaatctgcgaggcgacgtcagtgaggcggacgctctggagcaggattctccagccttccgttgtacgaacagtgaagtcacggtccagcccagcccctatctgagctacggcctgcccaaggacttcgtagacctttccaccggggaagatgctcacaagctcatagattttcttaagctgaaaagaaatcagcaagaggacgactgagcgctgcttggagaataagtcaagagggaaacagcttttcagaagcctcatatagaacacaacttcccagtgacccaaactaggtgcagatgggtgggcagtatgcaaaatcatcagcttttatattcgtgtatatttacctggagaaagatggaggacctttggtacttgtaaaagaaataacaatataataaatagatcttaaacacaaggaagcacactgtgatggtttgtatatgcttgggccagggagtggcactatgaggaggtgtggcctggttggagtagggggtgtcactatgggtgtgggctttaagaccctagtcctaactgcctggaagtcagttttttcctagctaccttcagctaagttcctcctgcaccatgcctgcctgggtgccgccatactcccaccttgatgataatggactgaaactctgaccctctgaacctgtaagccagccccagtgaaatgttgttcttataagagttgtcttggtcatggcgtctgctcacagcaactatgctaagacacacactgttctgaaaataaaataactttctacgaaaaaaaaaaaaaaaaaaaaaactcgaggtcgacctgcaggcatgcaagctt

SEQ ID NO: 4374 - DNA, 1305 bp, Rattus norvegicus
  Genbank Accession No. U36895
ggcacgagccgtgattaagggactttgaacttttcaagggatttggagttttatgaagaatttgaagatttacagagtttacaggaatggagctgaccagccactatgacatgccttatatctccaagagcataaatataaggcatggcatgagaggaccagcagccactgttctcatatatgatgaataagaacagcagagtccacactgattctaccataaggaataccttctccactgaaattggcattggaatcttagccaacagtttcctacttctcttccacatcttcaagtttattcgtggacagaggtccagactcactgacctgcccattggtctcttgtccctaatccacctactgatgctactgatgggggcattcatagccatagacatttttatttcttggaggggatgggatgacatcatatgtaaattccttgtctacttgtacagaagttttagaggtctctctctttgtaccacctgcatgttgagtgtcctgcaggccatcaccctcagccccagaagctcctgtttagcaaagttcaaacataagtctccccatcacgtctcctgtgccattatttcgctgagcatcctctacatgttcattagcagtcacctcttagtatccatcaatgccacccccaatttgaccacgaacaactttatgcaagttactcagtcctgctacattatacccttgagttacctcatgcaaagcatgttttctacacttctggccatcagagatatctctcttattagtctcatggtcctctcgacttgttacatggaggttctcttgtgtaggcacaggaatcagatccagcatcttcaagggaccaacctttccccaaaagcatctccagaacaaagggccacacagaccatcctgatgctcatgaccttctttgtcctaatgtccattttcgacagcattgtctcctgttcaagaactatgtatctgaatgatccaacatcttactatattcaaatatttgtagtggacatctatgccacagtcagcccttttgtgtttatgagcactggaaaacatatagttaactttttgaagtccatgtgtgtgagggtgaagaatgtttgaatattcattaatggacaagatcctttaagaggagccaatgtagtcatcagaactgtcagtcatggtgtgctgtctatgtgctttggtaaatgtgaatcatgaagttgtttttctggtaaaatgatttactttaaccaactcatgattgtaaacatgtaacaggagattaaacaatatccccttcggaaa

SEQ ID NO: 4375 - DNA, 678 bp, Rattus norvegicus
  Genbank Accession No. U39572
gcctgcaggtcgactctagagacagacacaacggtaacattatgctggacaagaagggacacatcatccacatagactttggcttcatgtttgaaagctcaccgggtggcaaccttggctgggagccagacatcaagctgacagacgagatggtgatgattatggggggcaagatggaagccacacccttcaagtggttcatggagatgtgcgtccgaggttatctggctgtgcgcccctatatggatgcagtcgtctccctggttacactcatgttggacacaggcctgccctgtttccgtggccagacaatcaaacttttgaaacacaggttcagcccgaacatgacagagcgggaggctgcaaattttatcatgaagatcatccaaaactgtttcctcagcaacaggagccggacctacgacatgatccagtactaccagaatgatatcccctactgaggagactgtacctgaagccttgagtgtcacagagcagcttgtactgtcaccataagcctgggtgtggaggtgacaggcacatggaacttggatgcacaggtgtgagtctttttcacactggatacactccctatttgttcacccatcttactatgttggtacatgaagtattttcctgtgtaaacatgagaaattgacataaaaaataagaacccta

SEQ ID NO: 4376 - DNA, 1778 bp, Rattus norvegicus
  Genbank Accession No. U39943
atatcagccatgcttgtcacagcgggttccctactaggggccatttggaccgtgctccatctccggattttgctgctggctgctgtcacctttctgttcctggctgatttcctcaaacaccggcgccccaagaactacccgccagggccttggcgcctgcccttagtgggttgcttgttccatttggatcctaaacagccacacctatcccttcagcagtttgtgaagaaatatgggaatgttttaagcctggattttgctaacattccttcagtggttgtaactggcatgcccttaatcaaagaaatctttactcaaatggagcacaattttttgaatcgccctgtcactcttctccgaaaacatctctttaacaaaaatggattgatcttctccagtggccagacatggaaggagcaaaggaggtttgccctgatgactctgaggaactttggactaggaaagaagagcttagagcagcgaatacaagaggaagcctaccaccttgtggaggccataaaagatgagggaggactgccttttgaccctcacttcaatatcaacaaagcagtctctaatatcatttgctctgtcacctttggggagcgctttgagtaccatgacagtcagtttcaggagatgctgaggctactggatgaggccatgtgtttggagtcatcaatgatgtgccagctctacaatatctttccaaggatacttcagtatcttcctggatcacaccaaacacttttcagcaactggagaaaactgaagttgtttatttctgatattattaagaatcaccggagagactgggatccagatgagccaagggacttcattgatgctttcctcaaggaaatggcaaagtacccagacaagactactacaagtttcaatgaagaaaacctcatctgcagtactttggatcttttctttgctggtacagagacaacatccactacactgcgctgggctctgctctgcatggccctgtacccagaagtccaagaaaaaatgcaggctgagattgacagagtgattggccaaggaagacagccaaacctggcagaccgagactccatgccctacaccaacgccgtcattcacgaggtgcagagaataggcaacatcatcccctttaatgttcccagggaagtggcagttgacacctatttggctggatttaacttgccaaagggtactatgattctaaccaacttaactgcactgcacagggaccctaaagagtgggccaccccggacaccttcaacccagagcactttttggagaatggacagtttaagaagagagaatcctttctgcctttctcaatgggaaagcgagcatgtcttggagaacaactggccaggtccgagctgttcatttttatcacttctcttatccaaaaatttaccttcaagcccccggtcaacgagaagcttagtctgcaattcagaatgtccgtcaccatttccccagtcagtcaccgcctttgcgcaattcctaggctgtgatgtcgaagaggaaagtatgaagaaatggcatctgcatggaggacactggtgtctgctcacattgaggggatagaattaaagatgactgagggagtgtgtgcaatgagactaaggaaattgaatcaagttatgggttcattaagtagaaagccacttgtgagctcaatggtacagcttcacgactgacatcttgcagagaaaaatgattcttccagaaaagaaaatgattacgggaccatggagaatggaagccgaattcc

SEQ ID NO: 4377 - DNA, 347 bp, Rattus norvegicus
  Genbank Accession No. U42719
cagacccgcaactttctggtccgggcttcttgccgccttcgtttggagcctagcaaagagtacttaatcatggggatggacggagtcaccagtgacctcaagggagacccccagtacttgctggactcaaacagttggatcgaggagatgccatctgagcacctgtgcaggagcacccgtcagcgggcagcctgtaccagctcaatgacttcctgcaggagtacagaagccaggggtgccaggtgtgagggcgtcggactctggatccctgagctcagccccagggtcagggcctctcacgaagcagggcctgcttaacagggtaaataaataaaacttttgacagt

SEQ ID NO: 4378 - DNA, 847 bp, Rattus norvegicus
  Genbank Accession No. U44948
acgagctagacctccctagctccgcccgccgcgtgctcccgcctcccactcggaatgcctgtctggggcggtggaaataagtgcggggcctgcgggagaaccgtgtaccacgctgaagaggtgcagtgtgatgggcggacgttccaccgctgctgctttctgtgcatggtttgcaggaaaaatttagacagcacaacagtggcaattcatgatgaagagatctactgcaaatcatgctacggaaagaagtatggaccaaaaggctatggttatggccagggcgctggcacgctcaacatggaccgtggtgagaggctgggcatcaagccagagagtgctcaacctcacaggcctacaacaaatccaaacacttctaaatttgcccagaaatatggaggtgctgagaagtgctccagatgtggggattctgtgtatgctgctgagaagatcattggagctggaaagccctggcacaaaaactgtttccgatgtgccaagtgtgggaagagtctggagtctacaactctgactgagaaggaaggtgaaatctactgtaaagggtgctacgcaaagaactttgggcccaagggattcggctatggtcaaggagcaggggcccttgttcatgctcagtagtggtgtaaacccagtaagcatggcaaagaacctccattaatgtggatggccttaccgcactcaggctgtgcatcggccagcactcagcactgtgtagcacacacgctatgtgcacaatcgggctggacaggaagcactacactctcctgcccatccgctaacgtttaagaacgttcttttacatttggaataaaattttggtttgatttga

SEQ ID NO: 4379 - DNA, 167 bp, Rattus norvegicus
  Genbank Accession No. U47316
caggtcacggaagccagtcatgccggagacaccggcttctgggaagccgcccaggtctcattcctccctgctgtttggaggcagcatctcctctttttatggagggcccgtccttttttcttacaaattcttcaataaagacacattcttgaggcgaaaaaaaaaaa

SEQ ID NO: 4380 - DNA, 1975 bp, Rattus norvegicus
  Genbank Accession No. U50185
cgcgagcagctgaagcgctggatcggctccgagacggacctcgagcctcccgtggtgaagcgccagaagaccaaggtgaagttcgacgatggcgccgtcttcctcgccgcctgctccagcggcgacacggacgaggtcctcaagctgctgcaccgcggcgccgacatcaattacgccaatgtggacggactcaccgccctgcaccaggcttgcattgatgacaatgttgatatggtgaagtttctggtagaaaatggagcaaatatcaatcaacctgacaatgaaggctggattccactccatgcagccgcttcctgtggatatctggatattgcagaatttttgattggtcaaggagcacatgtaggagctgtcaacagtgaaggtgacacacctttagatattgcagaggaggaagcaatggaagagctacttcaaaatgaggttaatcggcaaggtgttgatatagaagcagctcgaaaagaagaggaacgcataatgcttagagacgcgaggcagtggttgaacagtggtcacatcagtgacgtccggcatgcaaagtccggaggcacagcactccacgtggcagcggccaaagggtatacagaagttttaaaacttttaatacaggcaggctatgatgttaatattaaagattatgatggctggacacctcttcatgctgcagctcactggggtaaagaagaagcatgtcggattttagtggacaatctgtgtgatatggagacggtcaacaaagtgggccaaacagcctttgatgtagcagatgaagacattttgggatatctagaggagttgcaaaaaaaacaaaatctgctccatagtgaaaagcgggataagaaatctccactgattgaatcaacagcaaatatggaaaataatcaaccacagaagaattttaaaaacaaggaaacgttgattattgagccagagaaaaatgcatctcgaatcgagtctctggagcaagaaaaggctgatgaggaggaggaaggcaagaaggatgagtccagctgctccagtgaggaggatgaggaggatgactccgagtccgaagcggagacagataagacaaaacccatggcttctgtaactaatgctcacactgccagcactcaggcagctcctgccgctgtgacaacacctactctgtcttccaaccaggggacccctacatcacctgttaaaaagtttcctacatcaactacaaaaatttctcccgaagaagaagaaagaaaagatgaatctcctgcatcctggaggttaggacttagaaagactggcagttatggtgccctggctgagatcactgcatctaaagaagctcagaaggagaaagacactgcaggcgtgatacgttcagcttcgagtcccagactctcgtcctctttggataataaagaaaaggagaaagacaataaaggaacaagacttgcatatgtcgcccctacaatcccaaggcgactaggcagtacgtctgacattgaagagaaggaaaacagagagtcttcaaatttgcgaacaagtagttcttacacaagaagaaaatgggaagatgatcttaaaaaaaatagttcaatcaatgaaggatctacttaccatagaagttgctcctttggtagaagacaagatgatttgattagttgtagtgttccaagcaccacatcaacaccaacagttacctctccagctgggcttcagaaaagcttcctttccagcacaagcactactgcaaagactcccccgggttcctccccagcaggcacacagagcaggtcatacctcactcctgttagggatgaagagtctgaatcccacaggaaagcaagatctagacaagcaagacagtctagacggtcaacacagggggtgacactgactgacctccaggaagccgaaaagacaataggaagaagccgttctacgagaaccagagaacaagaaaacgaagaaaaag

SEQ ID NO: 4381 - DNA, 2661 bp, Rattus norvegicus
  Genbank Accession No. U50842
atggcagccgacgacactgaggccccagtgctttcggaggacgaggtatgggagttctgtctggataagaatgaagagggtggtggatcccccggaagtgatgtcacagatacttgtgagccaccatgtggatgctgggagttaaatccgagttccctggaagaggagcacgtgcttttcactgccgaatccataatctcgagcttcaacaatgatgacacgcgagttgtgagagtgaaggttatagctggcataggtctggccaagaaagacatcttgggagccagtgatccttatgtaagagtgacattgtatgacccgatgagtggagtccttaccagcgtgcagacgaaaactatcaaaaagtctttgaatccaaaatggaacgaagaaatactgttcagagtccttccacaacagcaccggattcttttcgaagtgtttgatgaaaatcgtttgacaagagatgatttcctgggtcaagtggatgtccctctctatcctttaccgactgaaaacccaagaatggagagaccatatacatttaaggattttgttcttcatccaagaagccacaaatcaagagttaaaggttatctgagattaaaaatgacttacttacctaaaaacggctcagatgatgaaaatgcagaccaggctgaggagttagagcctggctgggttgttttggaccaaccagatgctgccacccatttgcagcatccaccagaaccttctcccctacctccagggtgggaagagaggcaggatgtccttggaaggacctactacgtaaaccatgagtctagaacaacacaatggaaaagaccaagccctgaggatgacctcacagatgatgagaatggtgacattcagctgcaggcgcacggagcatttaccaccaggcggcagatatcggaggatgtggatggccctgacaaccacgagtcccctgagaattgggagattgtacgagaagatgagaacaccatctacagtggtcaggctgttcagtcgcctccgtcaggtcacccagacgtgcaggtccgcctcgcagaggagttagataccagactcaccatgtatggaaacccggccaccagccagccagtcaccagctcaaaccattccagcagaggaggcagctcgcaaacctgtatctttgaggaacagcctacacttcctgtgcttttgcctacttcatctggattgccaccaggttgggaagaaaaacaagatgacagaggacgatcgtactatgtagaccacaactctaagacaaccacatggtccaagcccaccatgcaggatgatccaagatcgaaaattcctgctcatctgagaggaaagacaccagtcgactccaatgacctgggacctttacctccaggctgggaagaaagaacgcacacagatggaagggtcttcttcataaatcacaatataaagaagacacagtgggaagatcctcggatgcagaatgtggccataactggaccagcagagccctactccagagattacaaaagaaagtatgagtttttccgaaggaagctgaagaagcagactgacattccaaacaaatttgaaatgaaacttcgccgtgcaaacattctggaggattcttaccggagaattatgggtgtgaagagagctgacttcctcaaggcccgactctggattgagtttgatggtgaaaagggccttgactatggaggagttgcccgagaatggttcttcctcatctcaaaggagatgtttaatccctattatggcctgtttgaatattccgctacggaggacaattacactctgcagataaatccaaactcgggcttgtgtaatgaagatcacctctcatacttcaagttcattggccgtgtggctgggatggcggtttatcatggcaagctgttggatgggtttttcatccgccccttttacaagatgatgcttcagaaactgataacactgcacgacatggagtctgtggatagtgaatattacagttctctgcgatggattcttgaaaatgacccgacggagctggacctgagatttatcatagatgaagagctttttggacagacacatcaacacgagctgaaaactggtggatcggaggttgtggtcaccaacaagaacaaaaaggagtatatctaccttgtaatccagtggcgatttgtgaacagaatccagaagcaaatggctgcttttaaagagggattttttgaactgataccacaggatctgatcaagatattcgatgaaaatgaactagagcttctcatgtgtggtctgggagatgtggacgtgaatgactggagggaacatacaaaatacaaaaatggatacagcttaaaccaccaggtcatccactggttctggaaggctgttttgatgatggattcagaaaaaagaatacgcttacttcagtttgttactggcacatcccgtgtgcctatgaatggatttgctgaactctatggctcaaatggaccacagtccttcacagtggaacagtggggcacccctgataagctgcccagagcacatacctgcttcaaccgcctggacctgccaccctatgaatcctttgacgaactctgggataaacttcagatggcgattgagaacacgcagggctttgatggggttgat

SEQ ID NO: 4382 - DNA, 2006 bp, Rattus norvegicus
  Genbank Accession No. U53184
gcgcgcgcggccagcgagacctcccggctccactggcggcgcgggcggcggtaaaatgtcggctccaggaccttaccaagcagctgcaggcccttctgtaatgcctactgcacccccaacctatgaagaaacagtgggtgtcaacagttactacccaacgcccccagcacctcagccgggaccagccacagggctcattacgggcccggatgggaagggcatgaatccaccttcgtactacacccagcccgtgcctgtccccaacgccaacgcaattgcagtgcagacggtttatgtgcagcagcccatctccttctacgaccgccccatccagatgtgctgtccttcctgcaacaagatgatcgtgacccagttgtcctacaatgcaggagccctcacctggctctcctgtggcagtctgtgtctgctgggatgcgtcgctggctgctgcttcattccgttttgcgtggacgccctgcaggatgtggaccattactgccccaactgcaaagcgctcctgggcacctacaaacgtttgtaggactcggccagccacaggggaggtagacaagtgctcccggaagtcacccaacccttgcccagcgcagccagaagacgtcccttccttgatctcttcatgagctcgtcttcgtgtcttttagggggtggggaaagtcggaaaagtaacaaacccccaaacccagaaactgctgctggagttgtgccctgcacatgcaaagacgtggaccttgggtgttgctttaagggtttaccgcctgatctcgttaccccactaactgtgattgttactccatttgcatctcgtctgctgatttgccactgcctgccccctcttcctcaagaagaggccttcctggtgccaggctcaaaacccgaagctacagtttgccttatttttcactgtttggcttgatctgtaccatctctcccagccctaatgacagagaccttgccttaaagactttgcggttctgtaattgcagacttctccagcactcagaatcactttcaattccatagagttgttcctctccacacacacccctcccccggtgcacagaagggctgccgacacccaccagactcatacagagaaggtcacaagtactaaatgaaaggctcccagcccaccttgtctcagcccctgtcctgtgaagggactccttcctcacacagtttctgtgacttccttttgttcttaaacacatggaagttacttggcagggagacatttctagaataatttttgtgatcacgatacacccttcattctccgtttgctggtatgtttttagttggtttggttttagttttccacatacagtctagctcgtggccagccttgagctccgaggagatcctccatcttctcctctcaaatacccagggcccagacatttgcctctgcacctgctgggctttttctctcatttttccttaaccagaaaaacaaacgggtaatttcatcgactgcctatgtaggtttggtgtggttttgaaaaccttgtttccatggggccctttgggggagtcagggggcccctgcacgagcccatgcttcaatgccgagagattggctgctggaaccccctgaagcatgatttcatgttttagagatgagcttctgtggtacggtcatcatggtctccaacatcaacagacaaggtagaaggatgtcaacgacaaagataagttcagggctctttctagggtcaccactctgtcctgtgtaacactgacacagtctggccagcctttcaggaggtcctggctccctcctaaacccatgtaggwcttgctgcaagtaacagtgtatgaagtcaacctgacctggaacagaagtctgcatattggttaagatacagcctatgtatcttcatacaacgatccagaagtactagacatcatttttgcagtgaattatgggtaccatacatgactttgatgatatctgcttttaaacaaataaaatctttgatcactca

SEQ ID NO: 4383 - DNA, 1330 bp, Rattus norvegicus
  Genbank Accession No. U53859
gaattcgttcttgaagggcggcggtggcggtgggggaggcgggggtctgggcgggggcctgggcaatgtgctcggaggcctgatcagcggagctgctggaggcggcggcggtggaggcggcggtggcggcatgggactgggaggaggtggcggaggcggtggaacagccatgcgtatcctgggcggagtcattagcgccatcagcgaggctgctgcgcagtacaacccggagcccccgcccccacgtagccattactctaatattgaggccaacgagagtgaagaggaacgtcagttcaggaaactttttgtccagctggctggagacgacatggaggtcagcgctacagaactcatgaatatcctcaacaaggtcgtgacccgacacccagatctgaaaactgatgggttcggcattgacacttgtcggagcatggtggctgttatggatagtgacaccacaggcaagctgggctttgaggagttcaagtacctctggaacaacattaaaaagtggcagggtatatacaaacgctttgatactgaccgatcagggaccattggtagcaatgaactcccaggggcctttgaggcagcaggattccacctgaatcagcatatctacagcatgatcatccgccgctactcggacgagaccgggaacatggatttcgataacttcatcagctgcttggtcaggctggatgccatgttccgtgctttcagatctcttgacaaaaatggcactggacagatccaagtgaacatccaggagtggttgcagctgactatgtattcctgagtggaagtcacagacctgccgcctcactgctcactgtggagccttgaacctgatcctgtctgcagccacgtttttacggtcatgtcctgctacccagaggccttccttttccctatgctggtacccagcttcccagtcggcagccagagctcaacgtgccccagcttgctgcaccctgagttcccctggctctgagacaagctagcttgctctgccgaagtgtcacccctacccccagtcacacccagtccgcaccctctgtgacctccatcctgtctgtgtgccaagcctagcactcctattgcttccatgtcccaagggccctgtctcagttctgggaggatcacgcctgtccctacacaccttgttacacactcacacagttacctcccaggcagccaaataaactccaggccatccagtgccacacaccctagtgcctatgcctgcactgttttccccctgcacagctgtcgggcccaagaggaaataaactctccattcgctgcttaaaaaaaaaaaaaaaaa

SEQ ID NO: 4384 - DNA, 1728 bp, Rattus norvegicus
  Genbank Accession No. U53873
aatctagcaaaatcaatccataatctctatttatttgttgaaaatgttgatcttaaccaaatcagtagtagtggtgcgtcttggatccaaaatgtggataccaaatatcaaatcagaatccagatacaagaaaaactccagcatctcagaacacagattcataatatagacattcaacagcttgctgcagagttaaaacaacagattgaagctcttgatgtcccaatgcatttagatcaactgagaactgcaattctattccaaagaataagtgtcattattgagcgtgtcaaatactttgttatgaatcttattgaagattttaaagtaactgagaaaatcaatacttttagagttatagtccgtgagttaattgagaaatatgaagtagaccgacaaatccaggttttaatggataaatcaatagagttggcccacagatacagcctgagtgagcctcttcagaaactaagtaatgtgctacagcaaattgagataaaagactactatgataaattggttggttttattgatgacactgtcgagtggattaaagcagtgtctttcaaaaatatcattgaagaactgaatagattgattgacatgtcggtaaaaaagttgaaagcctttgattatcaccagtttgtagacaaaaccaacagcaaaatccgtgagatgactcagagaatcaatgctgaaatccaagctctcgaactcccacagaaaactgaagcattaaaactgtgggtagaagacttcaaaaccacggtctccaactccctggaaaaactcaaggacaccaaagtaactgtggtcgttgattggctgcaggatggtttggctcaaataaaagcccaattccaagatgctttagaagatgtacgagaccgaatttatcaaatggacattcagggggaactggagcgctgcttgtctctggtaagccaagtttacagcacagtggtcacctacatttctgactggtggactctgactgctaaaaacataacagactttgcagagcaatattccacccaaaagtgggctgagagtgtgaaagcactggtggaacaaggattcattgttcctgaaatccaaacatttctggggaccatgcctgcatttgaggtcagtctccacgctctccaagaagctaactttcagactcctgactttatagtccccttgacagatttgaggattccatcaatttggataaacttcaaaatgttaaagaatgtaaaaatcccattgagattttccactccagaattcactctcctcaacaccttccgtgtccgttcctttacaattacgttgctggaaataaaagcaaagatcattcgaactatcgaccaaatgctgagcagtgagctacagtggcctcttccagaagtgtatttgagagccctggagatggtgaacatttctcttgcaagactctctctgccagacttccatgtaccagaaatcacaattccagaattcacaatcccaaatgtcaatctcaaagatttacaggttcctgatcttcacataccagaattccagcttcctcacctctcatgcacaactgaaatacctgctttcggcaaactacatagcgtcctgaaaatccaatctcccctctttatattagatgctagtgccaacatacagaacataactacttcagagaacaaagcagagattgtggcttctgtcactgccagaggagagtccaaattt

SEQ ID NO: 4385 - DNA, 787 bp, Rattus norvegicus
  Genbank Accession No. U53927
tggtccttctctttgtcatggtggctgggtttgtgaaaggaaatgtggctaactggaagatcagtgaagaatttctcaagaatatatcagcaagtgccagagaaccaccttctgaaaatggaacaagcatctacggggctggcggcttcatgccttatggctttacagggacgctggctggtgctgcaacgtgcttttatgcctttgtgggctttgactgcattgcaacaaccggcgaagaggtccggaatccccaaaaggctattcccattggaatagtaacttccttacttgtttgctttatggcctattttggggtttctgcagctttaacacttatgatgccttactacctcctggatgagaaaagcccactccctgttgcatttgaatatgtcggatggggtcctgctaaatacgttgtcgccgcaggctccctctgcgccttatcaacaagtcttcttggatccattttcccaatgcctcgtgtaatctatgctatggcggaggatgggttgcttttcaaatgtctagctcaaatcaattccaaaacgaagacaccaataattgctactttgtcatcgggtgcagtggcagctgtgatggcctttctttttgacctgaaggctctcgtggacatgatgtctattggcaccctcatggcctactctctggtcgcagcctgtgtgctcattctcaggtaccaacctggcttgtgttatgagcagcccaaatacacccctgagaaagacattctggagtcatgtaccaatgcgacctcgaagag

SEQ ID NO: 4386 - DNA, 1498 bp, Rattus norvegicus
  Genbank Accession No. U68544
cgcgcgccctcgcccgacccgtgacagcgatgctagctctgcgctgcggtccccgcctgctcggtctgctctccggcccgcgctccgcgccgctcctcctctccacgacccgtacctgcagcgacggcggagcccgaggcgcgaactcttcctcccaaaacccgctcgtgtacttggacgtgggcgccgacggacagccgctcggccgcgtggtgctggagttaaaggcagatgtcgtgccaaagacagcagagaacttcagagccctgtgcactggtgagaagggctttggctacaaaggctccaccttccacagggtcatcccagccttcatgtgccaggctggcgacttcaccaatcacaatggcacgggagggaagtccatctacggaagccgctttcctgacgagaacttcacactgaagcacgtgggaccaggtgtcctgtccatggcaaacgcaggccccaacaccaatggctctcagttctttatctgcacaataaagacagactggctggatggcaagcatgttgtgtttggccatgtcaaagagggcatggatgttgtgaagaaaatagaatctttcggctcaaaaagtgggaagacatctaagaagattgtcatcacagactgtggccagttgagctaagtcacagccaaggtgctaggacagcagcaggcagccatgtcttggttcacccaggtactccaaagaactgtttgtacccacttctactgagtatgaggaaggccacttgggcacatggtcccccacaggaccaggctgctctcaactgtccatccttcctcagatccatttctgggcatcagcatggccactgggccatgtatccttagcaagtgtctcggtgattgccattgtgtgtgccttggacatcggcaatgctgaccagttagtcagagaaggctcctgcctttttccttgaccagcggggacagcagttgctatttaatgttgtcttcctcattgcaataatttaacaagatctcataggaacaagctactacactaactgcactgtctatgtgtgactgagttggcacaagccacagacaccccaccaccaccaccaccaccaccaccaccacctccccgcctggcttctgaaacataactcagggctcttgtgaaagtcccaccatcaatgcctctccttctggtcactgtgaatcctgctggttggctgctgtgattttctgaaaggagcctgtgaaatagaagcagctggacctggggacagacctgtgagccaggcctgtctgctcaatgtgaattcctgtgttgaaaacttacagaaactgcctgaattcatgctctcctcaagagggaagtgttttctggtaggctttgctttttctgtatgttaaatcaatcaatcaatgatatatatgtagaagatttctgaacagtcctctgtgttcatctcaaatgtgataaataaatcctattttctataaaaaaaaaaaaaaaaaaac

SEQ ID NO: 4387 - DNA, 854 bp, Rattus norvegicus
  Genbank Accession No. U70210
gcggccgcgtcgaccatgttgcggtatcagaagtgcttggttgccaggccaccttcgcagaaagtccggcccccgcccccgccagcagattcagtgacccgaagagtcacgaccaatgtgaaacgaggggtcttatccctcattgacactttgaaacagaagcggccggtcacagagactccctagcagcccaggtctggaggagtctgacaccattacctgaggatcaagtagctacactaaagaagccgatacctggccttccactcagttgccgatgctttgtctccagagattttatctttaaccagacagtgttagacaagcatgtgacctcgtcttgccgccaccatgtgatataaagaggagcatgattttttctttcctgtaagttacatcatgagcagcagaaggtcgtcttcttgtaaatattgtgaacaggacttccgagcacacacacagaagaatgcggccacacccttcctagccaactaacactgcatccttggacgaacggtgcccaagttcattttgctgtcctcttgactggatctgtcacaagccaacttggggtccctcagcactttgccctgatttcggatcctgagtaacagataccactgaattgctgtaacaatggggtgacacctttgggttttagtttttcataacactgagcctgttggttgacaaaacttggctgttggcgtcggtacagacaccagccaccgagctctctgacacatggacactggttcacatctacagctatttgaggtgccgggcaaaggagaactttaaaattgatagaaaactaaatttgaggaattaaaatcaagcaaaaaaaaaaaaaa

SEQ ID NO: 4388 - DNA, 202 bp, Rattus norvegicus
  Genbank Accession No. U70268
cctagtgctaccttagcatgtgagctgctgctgtcacatactaatcacgtcttgccgtcccctctcctctgtatgcctgactgaactatgtacttgaaatgtagtgctacacttggagagttgttagcgctctgctcccactctctgtctctcttctttcatgtgtgggtaaataaaggcgcccggagagggcaagtgactt

SEQ ID NO: 4389 - DNA, 1051 bp, Rattus norvegicus
  Genbank Accession No. U72632
  misc_feature (1)..(1051): n = a or c or g or t
agctgctctgctcggcctagcgcctgggcnaccccagccaggaggagtccgtttctggtagaagcctgtccagcctcaaggaacaatgacccagaagaccaccctagtgctcctcgccctggctgtcatcaccatcttcgctttggtttgcgtcttgctagctggcaggagcggagatgggggcagactgagccaacctcttcattgcccttccgttcttcctagcgtccagccccagacacactctggccagagccagccgtttgcagacctgagccctgaggagctgacagctgtgatgagctttctgatcaagcacctggggccagggctggtggatgcagcccaggctcgaccctcggacaactgtgtcttctcagtagagttgcagctgcctgccaaggctgcagccctggcccacctggacagaggggggcccccacccgtgcgggaggcactggccatcatcttctttggtggacaacccaagcctaatgtgagcgagttggtggtggggcccctgcctcacccctcatacatgcgggatgtgactgtggagcgtcatggcggccccctgccctattaccggcgtcctgtgctgaccagagagtatcaggatattcaggagatgatctttcacagagagctgccccaagcgtctggtctcctccatcactgttgcttctacaaacgccaaggacacaacctgctaaaaatgactacagccccccgtggtttgcaatcaggggaccgggccacctggtttggcatatattacaatctctcaggggctgggttttaccctcaccccattggcttagagcttctggtagatcacaaggccctggatcctgccctgtggaccatccagaaggtattctaccaaggccgttactatgagagtctgactcagctggaggacatgtttgaggctggcctggtgaatgtggttttggtcccagacaatggcacaggtgggtcctggtctctgaagtcttcagtgccaccaggccgagctcctcctctgcarttycayccngarggnccnmgn

SEQ ID NO: 4390 - DNA, 1142 bp, Rattus norvegicus
  Genbank Accession No. U72660
ctgggcggcccgggcggccgcaccatggatcccggcaccgaggagtacgagctcaacggcgacctgcgccctggctctcccggttcccccgacgcctcgccaccccgctggggtttgaggaaccggcccatcaatgtaaaccattacgccaacaagaagagcgccgcggagagcatgctggacatcgcactgctcatggccaacgcgtcgcagctcaaggccgtggtggagcagggcaatgagttcgccttcttcgtgcccctcgtggtgctcatctccatctctctcgtgctgcagatcggagtgggcgtgctgctcatcttcctggtcaagtatgacctcaacaacccagccaagcacgccaagctggacttccttaacaacctggccacggggctggttttcatcatcgtggtggtcaacatcttcattacggcctttggagtccagaagcctgtcatggacgtggcaccccggcagtaggatgcccagagaccttgaaggtatctgacctgcagcccagctgtccagacccctgcaactgctgtatccccaaggcatccctctcctgttcacagcccaaggtggcctccgctggaccatggtcaaggatggacttccgtccacctgtgactgctgcgtgggcggccacccgaggcgtgtgggaactggatgcaaagccatgaagatcagaactggacagttccaccgaaacccacgcccagaggatgatcactgcccgcccaaggacatgcaggaaatccatgattggactcgatgaggggccagaactgatctctgtctcaggacattccagaaggaccaggatatgcccctccctttgctgatacaccagtgaccctacttctcatggagcatgcacaggtcaccctggagactgctccctttgttgtttcctgacccagggaccttggacagtcatcagtacctgctggctccagcctcagtgcctgggcttggcagtgtctcttggcatcgagaggcagccatgcctgtgggggctgcaggtcatcctggtaccttctaccagtagtgacttgggaagagccccaccccccaacccaggggctcaggccccaattttctaatcaggaatgacaataaagcttatgtcttccccc

SEQ ID NO: 4391 - DNA, 741 bp, Rattus norvegicus
  Genbank Accession No. U75411
ttcattgtacttaggaagcaaaatctgagtgttctcaccatgacatggactctactgttccttgccttccttcatcacttaacagggtcatgtgcccaggctgtccttgcgcaccgaaactctgtgtctacgtctctaggaggcacggtcaaactgtcttgcacactcagctctggtaacatagacagcaactatgtgcactggtaccagcagtatgaggggaggtcacccaccactatgatttataatgatgataagagaccggatggtgtccccgacaggttctctggctccattgacagctcttccaactcagccttcctgacaatcaagactgtggaaattgaagatgaagccagctacttctgtcattcttatgttagtggcatgtatcttttcggcggtggaacaacgctcactgtcctaggtcagcccaagtccactcccacactcacagtatttccaccttcaactgaggagctccagggaaacaaagccacactggtgtgtctgatttctgatttcttcccgagtgatgtggaagtggcctggaaggcaaatggtgcccctatctcccagggtgtggacactgcaaatcccaccaaacagggcaacaaatacatcgccagcagcttcttacgtttgacagcagaacagtggagatctcgcaacagttttacctgccaagttacacatgaagggaacactgtggagaagagtctgtctcctgcagagtgtgtc

SEQ ID NO: 4392 - DNA, 196 bp, Rattus norvegicus
  Genbank Accession No. U75921
  misc_feature (1)..(196): n = a or c or g or t
agtgagaantttatgtctwaaaataaatttttganaaatttcatcttttttggganagttctttctggtccaccttttacccaagggttattttaccttaaccccagttgtcttcagactttccggtgtctcctcctttgtcgtggcgaagcaacttgttaccgatcaattgaatgaaaaaaaaaaaaaaaaaaaa

SEQ ID NO: 4393 - DNA, 519 bp, Rattus norvegicus
  Genbank Accession No. U75925
  misc_feature (1)..(519): n = a or c or g or t
gggtcccagtttgacctcagactgttgtgctggcagcganaatttcaggccagtggagcttagcttgctgggctccactggggtgggatccactgagctagaccacttgtctccctggcttcagctccctttccaggggagtgaacggttctctctcactggtgtttctggtgccactggggtataaaaaanaaactcctgcagctagcttggtgtctgctcaaatggccgcccagttttgtgcttgaaacccagggccctggtggtgtangcatctganggaatctcttantctgtgggttaagaagaccgtgggaaaagttgtantatctgggccagaatgcaccattcctcacaacacantccctcacgggttcccttggctaagggcaagattccctgacccttgtccttccaggtgaagcaatgcccccctgcttcttccggtcncctccatggaatcntcctttctancatccatgaaaaaacngttnccnttggaatgccaaancccccccc

SEQ ID NO: 4394 - DNA, 1026 bp, Rattus norvegicus
  Genbank Accession No. U77697
gccttggtagagcacagtggacactacacgtgcaaagtggaatcgaaccgcatctccaaggccagtagcatcctggtcaacataacagagctgtttcccaggccgaagctagaactctcctccagccgcctggaccaaggggaaatgctggacctgtcctgctctgtctcgggtgcgcctgtagctaacttcaccatccagaaggaagagacggtgttgtcacagtatcagaatttcagcaagattgccgaggagagggacagcgggctgtacagctgtacagcaggcatcggcaaagtggtcaagagaagcaatctggtacccgtccaggtgtgcgaaatgctctccaaaccccggatttttcatgatgccaaatttgagatcataaaaggacaaatcataggtatcagctgccagtcagtaaatgggactgcacccatcacttaccgcctcctaagagcaaagagcaacttccagaccgtccagaagaactccaatgacccagtgacattcacagacaagcccaccagagacatggaataccagtgtatagtggataattgccactctcaccccgaggtgcgcagcgagatcctgagggtcaaggtaatagccccggtggatgaagttacgatctccatcctgtcgggtaatgatgtacagtctggagatgaaatggtgcttcggtgctctgtgaaagaggggactggccctgtcacgtttcagttttacaaagaaaaggagggcagacccttccacgaagaaactgtgaatgacacccaagtgttttggcaccatgaacaaactagcaaggagcaggaaggccagtactattgtacagcgttcaacagagccagcattgtgaccagtctccgaagcggccctctaacagtcagagtctttcttgctccgtggaagaaagggctcattgcagtcgttgtcattggagtggtcattgccgccttgatagttgcagccaaatactacttcctgaggaaagccaaggccaagcagaagcccgtggag

SEQ ID NO: 4395 - DNA, 429 bp, Rattus norvegicus
  Genbank Accession No. U77829
gtgaggcgaagctgagcaggaatggccctgtggacctctgtgatgggacatctggtggaatctcacaggcagttctgtggcaaagatggatgaaagctaaggactcatgaggaagctggataactgaacaaagccatgtacaagaatgggaagccagaaaatgggatggtggagtttgaatcaggtggacagttctaaaagtacaaatgatttcgtataaaggtaccacatgtgggtccctttaactgaaggcatggcaagctccacacaaggtccttcatttctgaatttcaagggctcctctgacaagtggacagtgcagtgggtgcaccttttccagaggtgactggatggatgcttgaacagaagatttgccaaatagacattgtgctgtcaagaattttaccattaaaagtgcattattgtagc

SEQ ID NO: 4396 - DNA, 936 bp, Rattus norvegicus
  Genbank Accession No. U78977
caggaacgcaccggaaagctcacctgtgcagtaggggacggaggcaatgacgtcagcatgatccaggaatcagactgcggcgtgggcgtggagggcaaggaaggaaagcaggcttcgctggccgcggacttctccatcacccagttcaagcatctcggccggctactcatggtgcacggccggaacagctacaagcgctcggcggctctcagccagttcgtcatccacaggagcctctgcatcagtaccatgcaggccgtcttctcttccgtgttctactttgcatccgttcctctctaccaaggcttcctgatcatcgggtattctaccatctacaccatgtttcccgtgttttccctggtcttggacaaagacgtgaagtcagaagttgccatgttgtatcctgagctctacaaggacctcctcaaggggcggccactgtcctacaagacgttcttaatttgggtgttaatcagcatctatcaagggagcaccatcatgtacggggcgctgctgctgttcgagtccgaatttgtacacatcgtggctatctctttcacgtcactcatcctcaccgagctactgatggtggcgctcactatccagacgtggcactggctcatgacagtggccgagctgctcagcctggcctgctacatcgcctccctggtgttcctccacgagttcatcgatgtctacttcattgctaccctgtcgttcctctggaaggtgtccgtcatcaccctggtcagctgtctccccctctacgtcctcaagtacctgcggagacggttctccccccccagctactccaagctcacttcataagctgcaaggcggcagcagggcctccggtctctgcgctctccctggaggaggtcaagttcaggcgcatgaccacctcaggtggatggcgcagtcacagctggcacatga

SEQ ID NO: 4397 - DNA, 678 bp, Rattus norvegicus
  Genbank Accession No. U86635
atgtcgtgctccaagtctatggttctgggttactgggatatccgcgggctggctcatgccatccgtatgctcctggagtttactgataccagctatgaagagaaacagtacacgtgtggggaagctcctgactatgatagaagccaatggctggacgtgaaattcaagctagatctggattttcctaacctgccctaccttatggacgggaagaacaagatcacccagagtaacgccatcttgcggtacatcgcacgcaagcacaacatgtgtggtgacaccgaagaagaaaagattcgagtggacatcatggagaaccagataatggacttccgcatgcagctggttcggctctgctacaattctaaccacgaaagcctgaagcctcagtatttggaacaactgcctgcacagctgaaacagttctcgttgttcctggggaaattcacatggtttgcaggagaaaagctgaccttcgtggattttctcacttatgacgtcttggaccagaatcgtatgtttgagcccaagtgcctggatgagttcccaaatctgaaggctttcatgtgccgttttgaggctttggagaagattgctgcattcctgcagtctgaccgctgcttcaagatgccaatcaacaacaagatggccaagtggggtaacaagagcatatgctga

SEQ ID NO: 4398 - DNA, 1547 bp, Rattus norvegicus
  Genbank Accession No. U89280
  misc_feature (1)..(1547): n = a or c or g or t
ccggaaagaacaaacagggcagaagaaaggtgatttcctctttcctaaacctggaacactttaattctgtccacaagggcagagtggtgaactcccagcaatctaggactcaacctttagcctttagcctcactctgagggttatggtgatcaattttcctggatctgaagacttggacatggactgagacctcagttacagacagcctgttgtgagacttctcagcctctatgattactgctcctggacattccctcataatgtggttttacctggtgactcttgtgggcctttactaccttctgcgttggtatcgtgaaaggcaggtggtgagccatctacatgacaagtatgtcttcatcacgggttgtgactctggctttgggaacctgctggccagacagctggacaggagaggcatgagggtgctggctgcatgtctgactgagaagggagcagaggagctgaagagcaagacatctgacaggctggagacagtgatccttgacgttaccaacacagacagtatttcagcagccactcagtgggtgaaggagcatgttggagacaaaggactctggggtttggttaataatgcaggtgtgtttcaagcatttgcctacattgagtggtgccgaccggaggactgcatgtctatctttcaagtgaacctcattggtttggcacaggtgactctgagcatgcttttcctggtaaagaaggctcggggcaggatcgtcaacgtctccagtgttttgggaagagttgcattgtttggaggattctacagttgctccaagtatggagtcgaggcattttcggacgtgctaagacgtgagattcgagattttggggtgaaagtcagcataattgaacctggaagcttcaaaacgagaatgactgacgcagagctaagcattgagaaaaccaagaaaacctgggaggcgacccctgagcacatcagggagtcctacggacagcagttttttgatgacttttgcaacaccaccagacgagaactgaagaagtgcagcacgaacctgagcctggtcacagactgcatggagcacgctctgacctctaagtatcctcgcacccggtactcagctggctgggatgccagacttttcttcatccctctgtcttatttgcctacatcactggtagactgcctactggccatatctaggcgcaagccagctcaggcagtctgaaggatcctgggtcggcggctctgggaatgaanaaacaactcagttattcccagctcaagctgtgtgcgctgacatactttcttgcctaaaccacgtatgggctgtcttttcctcttctacacccacaggcacctggcctcgctctataaccctggctggcagcaaactcatagaaaacgtctgtctctctcttaatcaaggcgtttgcattccaggcgtacaaaacttagtactaacttagccactttttcctggggatatttccatattgtgttattctttcttgtcctattaaaaagtatcccatataagaacaaaaaaaaaaaaaaaaa

SEQ ID NO: 4399 - DNA, 4413 bp, Rattus norvegicus
  Genbank Accession No. U90725
  misc_feature (1)..(4413): n = a or c or g or t
ggcgtcttgttcctgtttcgccacagttcctaccttatgagcttggattcctcacgctaataaaagaggagcagtaaaagctggcaggctgacagaggcaacctcaggacggactttctggctactgaccattttgctgtgtcttactaggattgtgtgtggacgtgagatcaaccatgagctccgttgcagttttgacccaagagagttttgctgaacatcgaagtgggctggttccacaacaaatcatagttgccacattaaattcagaagaagaaagtgaccctccaacctacaaggatgccttccctccactgcctgagaaagcagcttgcttggaaagtgcccaagaacctgctggagcctggagtaacaagatccggcccatcaaggcctctgtcatcactcaggtgtttcatgtacccctggaggagagaaaatataaggacatgaaccagtttggagaaggtgaacaagcaaaaatctgccttgagatcatgcaaaggactggtgctcacctggagctctctctggctaaagaccaaggtctctccatcatggtctcagggaagctggatgcagtcatgaaagcccggaaagacattgttgctagactacagacacaggcctcagccactgttcccattcctaaagagcaccaccgctttgttattggcaaaaacggagaaaaactacaagacttagaactgaaaactgctaccaaaatccagatcccacgcccagatgaccccagtaatcagatcaagatcactggcaccaaagaaggnatcgagaaagctcgccatgaggtccttctgatctctgctgagcaggacaagcgtgccgtaaagaggctagaagtggagaaggccttccaccccttcatcgctgggccgtacaatagacttgtgggtgaaatcatgcaggaaacagggacgcgaatcaacatccctccacccagtgttaaccgtacagaaatcgtcttcactggagaaaaggaacagctggctcaggctgtggctcgtattaagaagatttatgaggaaaagaagaagaagactacgaccattgcggtagaggtgaagaaatctcaacacaagtatgtcatcgggccgaagggcaactcactgcaagagatcctggaacgtactggagtctccgttgagatcccgccctcagacagcatctccgagactgtgatacttagaggcgagcctgaaaagctgggacaggcattgactgaagtctatgccaaggccaacagttttacagtgtcctcagtctctgccccttcctggcttcaccgtttcatcattggtaagaaagggcagaacctggccaaaatcactcaccaaatgccaaaggttcacattgagttcacagaaggtgaggacaagatcaccctggagggccccacagaagatgtgaatgttgcccaggaacagattgaaggaatggtcaaagacctgattaatcggatggactatgtagaaatcaacattgaccataaattccacagacacctcattgggaagagtggagccaacatcaacagaatcaaagaccagtacaaagtgtctgtgcgcatcccccctgacagcgagaagagtaacctgatccgaattgagggagacccacaaggtgtgcaacaggccaagcgggagctgctggagcttgcttctcgcatggaaaatgagcgcaccaaggatctaatcattgagcaaagatttcatcgcacaatcattgggcagaaaggtgaacggattcgagaaattcgtgacaaattcccagaggtgatcatcaactttccggatccagcacaaaagagtgagattgttcaactcagaggccccaagaatgaggtggagaaatgtaccaagtacatgcagaaaatggttgcagatctggtggaaaatagctattcaatttctgtaccgatcttcaaacagtttcacaagaatatcattgggaaaggaggtgcaaacattaaaaagattcgtgaagagagcaacaccaagattgaccttcctgccgagaacagcaactcggagaccattgtcatcactggcaagcgagccaactgtgaagccgcccggagccggatcctgtccatccagaaagatctggccaacatagctgaggtggaggtctcaatccctgccaaactacacaactctctcattggcaccaagggtcgtctgatccgctccatcatggaggaatgtggtggcgtccatattcactttcctgtggaaggttctggtagtgacactgttgtcatcaggggtccttcctcagatgtggagaaggccaagaagcagcttctgcacctggctgaggagaagcaaaccaagagttttactgtggatatccgggccaagccagaataccacaaattcctcattggcaaagggggaggtaaaatccgcaaggtgcgcgacagtactggagcccgcattatatttccggctgctgaggataaggaccaggacctgataacaatcataggaaaggaagatgctgtccgtgaggcacaaaaggagctggaagcattgatccagaacctggataatgtggttgaagactacatgctggtggaccccagacaccaccgccattttgttatccgaagaggacaggtattacgagagattgctgaagaatatggcggggtgatggtcagcttcccacgctctggcacacagagtgacaaagtcactctcaagggtgccaaagactgtgtggaggcagccaagaagcgaattcaggaaatcattgaggatctggaagctcaagtaacgctggaatgtgctataccccagaagtttcatcgttcggtcatgggtcccaaaggttcaagaatccagcagatcactcgggactacaatgttcaaattaagttcccagacagagaggaaaacccagttcacagtgtagagccttccatccaggagaatggagatgaggctggagagggcagagaggccaaggagaccgacccgggatctcccaggaggtgtgacatcatagttatctctggccggaaagagaaatgtgaggctgccaaggaagccctggaggcactggttccagtcaccatcgaggtagaggtaccctttgatcttcaccgctacatcattgggcagaaaggaagtggaatccgcaagatgatggatgagtttgaggtgaatatacatgtgccagcccccgaactgcagtcacacaccattgccatcactggccttgcagcaaatttggacagggctaaggcggggctactggatcgagtaaaggagctgcaggctgagcaggaagatcgggctttaaggagttttaagctgagtgtcactgtagaccccaaataccatcccaaaattatcgggggaaaaggggcagtgatcacacagatccgattggaacatgatgtgaacatccaatttcctgataaggacgatgggaatcagccccaggaccaaatcaccatcacagggtatgagaagaacactgaagctgcccgtgatgctatcctgaaaattgtgggtgagcttgagcagatggtttctgaggatgttcccttggatcaccgtgtgcatgcccgaatcattggtgccagaggcaaagccatccggaaaatcatggatgagttcaaggtggacattcgcttcccacagagcggagctccagaccctaactgcgtcactgtgacaggactcccggagaatgtggaggaagctatcgaccatatcctcaacctagaagaggaatatctggctgatgtggtggacagtgaggcgctgcaagtttacatgaagcccccagcacatgaagagtccaaggcaccatccaaaggctttgtggtgcgagatgctccctggacctccaacagcagtgagaaggctcctgatatgagcagctctgaagaaattcccacctttggggctcaagtggcccccaagaccctcccgtggggccccaaacgataatgatcaaaaagaaactttccagcctgctgcccaaacccaaccacacaatggtttgtctcaatctgactcagcagctggaccctcgtaaattgttgatgctccccctccccgaagtctcgcagcaaagcctggtgggctggccttctgtggctgcttcccctggcctggtcagcacccgcaggctcagggtctgctcctgacgctgtgctctgggaaagtgcacgccactgcgtgaaacactaagcaaggtaatcgagcatttcgtgatcacagactccagcttcctggtccacccagcatgtagtcagcattctgactttcacagcagagttccacagcggctaggagttgacttccttgtgtcatgacctcaggaaataaatttccttgactttataaaagccaaaaaaaaaaaaaaaaaaaaaaaaaa

SEQ ID NO: 4400 - DNA, 1053 bp, Rattus norvegicus
  Genbank Accession No. U94856
ggactggtgttggcactttacaagaaccatcggtcttcctatcaaacaagattaaatgctttccgtgaagtaacaccggtagatcttcctaactgtactttagttaaaggaatcgaagcgggtgctgaagacttagagattctgcctaatggactaactttctttagcacatttttaaagtatcctggaataaaaagtttcgatcccagtaagcctggaaaaatacttctgatggacttgaatgagaaggagccagcagtgtcagaattagcaattatgggaaatacgttggatatgtcttcatttaacccacatgggattagcacattcatagatgaagataacactgtgtacctactggtggtaagccacccagactcctcgtccaccgtggaggtgtttaaatttcaagaagaggaaagatcacttttgcatctgaaaaccatcacccatgaacttctgcctagcatcaacgatatagctgctgttggacctgagagcttctatgccacaaatgatcactattttgctgacccatacttacggtcctgggaaatgtacttgggcctgtcatggtccaatgttgtatactacagtccagataaagtccgagtggtagcagatggatttgatttcgctaatggcattggcatttcccttgatggcaagtatgtctatatcgctgaattgctggctcacaagattcacgtgtatgaaaagcatgctaattggactttaacgccattgaaggtcctcagctttgacacccttgtggataacatctctgtggatcctgtgacaggggacctctgggttggatgccatcccaatgggatgaggatttttttctatgactcggagaatcctcctggctcagaggtgcttcggatccagagcattttatccgaagaccccaaagtaactgtagtttatgcagagaatggcacggtgttgcaaggtacgacagtcgctgctgtgtacaaaggaaaactgctgattggaacggtgttccacagagctctttgttgttacctgtgacaagctggctacacc

SEQ ID NO: 4401 - DNA, 405 bp, Rattus norvegicus
  Genbank Accession No. U95052
taatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagtttgagagatcattaatgcccttgaagtggtttttgtgggtgtgaaacaaatggtgagaatttgaattggtccttcttattatagtattgaaattaagtctacttaatttatcaagtcatgttcatgccctgattttatatacttgtatctatcaataaacattgtgatacttgatgtagttgtaaaaaaaaa

SEQ ID NO: 4402 - DNA, 2412 bp, Rattus norvegicus
  Genbank Accession No. X00722
atttcttacgtgtgtctcgtttcgtttctcgctggccggcctgaggcggagccccctcgccgtcgggcccctcccatcccgcgcaggaggggcgggcgggggcgcttgttgcggtcgtcagcaccccgtgtgcggagtcccgctcacacctcagataaccgtacgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgacgatcaatcgccgccccccttgcggtttcgccgccgcgggggggatcgcgtcgcgcggctgggagtctgctcgcagggccccgctccccggggccctccgtctcccgaagttcagacgcgggcggcgtccggcgttcgcccgcgccccgtgggtccgcgcgggctcgtcctccctgcccgccgtcgtcgtgcggccgggcggccctcctcgcggctccttccccgcgcgctccgccgctcccgctcccgtcctcgcccgctctcccccgccgtggggacgcgtcggcgtgggccggtcgggtgtctgggcgcgagagggggggggaaagtcgcgtcgccggggtcgttcgccgcgcctccggtggggtgggaggcggggacccgcctgcccgcccgcggggccggcgcgtccgccgccgccgcgcgcccgcccggtgcgtgcggagagagagagagagagagagacccgcgagggtcgttcgggggggccgtaccgcgcccgcggggccggtctcgcgtccctctcctcccccgctccccctcggggccgacgctccggtgccggcccgcggcgccgcggcgtccgtgcgccgacgcgacttgcccccgggatgcggggccggccggcgaaggagaggtcgcgggccccggcctggctcccccggcgccctcgccccgtcgtcccgtcgttctcgctctcgctctcctctcctctcctctccttccgtcgcccgcgcgcgcccacctctcctccttctcctcctctggaccgcgacctcagatcagacgtggcgacccgctgaatttaagcatattagtcagcggaggaaaagaaactaaccaggattccctcagtaacggcgagtgaacagggaagagcccagcgccgaatcccgccgcgcgccgcggcgcgggaaatgtggcgtacggaagacccactccccggcgccgctcgtggggggcccaagtccttctgatcgaggcccagcccgtggacggtgtgaggccggtagcggccccggcgcgccgggcccgggtgttcccggagtcgggttgcttgggaatgcagcccaaagcgggtggtaactccatctaaggctaaataccggcacgagaccgatagccaacaagtaccgtaagggaaagttgaaaagaactttgaagagagagttcaagagggcgtgaaaccgttaagaggtaaacgggtggggtccgcgcagtccgcccggaggattcaacccggcggcgcgtccggccgtgccggtggtcccggcggatctttcccgcaccccgttcctcccgacccctccacccgcgcgtctctctcccccctccccgcgtcccgccgtcgccgtccccgctcctccctccgggggggtgtcggcgggcgctccggcggcgggcgcgggtgtggtgggggcgcgcgggcggggccgggggtggggtcgggcgggggaccgccccccggtcggcgaccggccgccgccggcgcacttccaccgtggcggtggcccgcgaccggctccgggacggctgggaaggcccggcggggaaggtggctcggggggggcggcgtcacccgtgggcgccggaccccgccccgagtgttacagcccccgggcagcagcgctcgccgaatcccggggccgagggagccggatacccgtcgccgcgctctccccccggcctctcccctcccgcccctccccgtggggtggcggaaaggggggcggtcgcgggggccgggccgcccctcccacgggcgcgaccgctctcccaccccccgcgcctccgtcgccctctcggggtccggggcccggggggcggggcgaactctccccagtgcgccccgggcgtcgtcgcgccgtcgggcccggggggccgtcctcacgcgctctccccccccttctcggggtgggggggagcgaagccgagcgcacggggtcggcggcgatgtcggctacccacccgacccgtcttgaaacacggaccaaggagtctacgcgtgcgcgagtcaggggctcgtccgaaagccgccgtggcgcaatgaaggtgtgggccccgttcccgggggccccgaggtgggatcc

SEQ ID NO: 4403 - DNA, 331 bp, Rattus norvegicus
  Genbank Accession No. X02284
ctgcctgaccactaatccattggagacacccacagtcatgtgtacagttgtcttgtatttttttgtttgtttgtttgtttttttagacctgtcatcatggctcaccgatttccagccctcacctcagagcagaagaaggagctctccgagattgcgcagcgcattgttgccaatgggaagggtatcttggctgcagatgagtctgtgggtgagtgtaagaaagtcatgccacacaaggcacaccgtgcttgcaccttggaaaaggcagttagacaatcagtctccttccacacagaggaagtaaaggtttatgtacttagtgagtgcaggc

SEQ ID NO: 4404 - DNA, 557 bp, Rattus norvegicus
  Genbank Accession No. X02291
ctgcagatccttaattcagtcttctcttacgcttggttttcaggccaactgtcaggcagcccaaggacagtatgttcacacgggctcgtcaggcgctgcttccacgcagtcactcttcacagcctcctacacctactagataccgtcacctaccagccagctccagttgtcctaaatattttggttggagacctcaaaggcttcagtcagccctgaaattagatcacatctgattgaacttttgaaaacaccacatactgcgaatcagctgttgaagtgcggagtatgagcacgtcacccagtagtctccgaacacctccagttccccgtgttccagaacatccatccaagagaaggaacgggctttacatggaaggtcagtcttccatgcatacagccactactgagcaaagcagctcggaagggaaggaggagaagggcattttaacaaacatacttaccgggggttggttagagaagaggcacagcagcagaaaaagaaataaaaagtctatgaaccttcagttggtactgtttcactgctctgctctgctcga

SEQ ID NO: 4405 - DNA, 1121 bp, Rattus norvegicus
  Genbank Accession No. X05472
aagatgaactctcaatcctaaatatctatgccccaaatacaagggcacctacatacgtaaaagaaaccttactaaagctcaaagcacacattgcacctcacacaataataatgggagatttcaacacaccactctcatcaatggacagatcatggaaacagatattaagcaatgatgtcgacagactaagagaagccatgagccaaatgggcttaacggatatttatagaacattctatcctaaagcaaaaggatataccttcttctcagctcctcatggtactttctccaaaattgaccatataattggtcaaaaaacgggcctcaacaggtacagaaagatagaaataatcccatgcgtgctatcggaccaccacggcctaaaactggtcttcaataacaataagggaagaatgcccacatagacgtggaaattgaacaatgctatactcaatgataacctggtcaaggaagaaataaagaaagaaattaaaaactttttagaatttaatgaaaatgaagatacaacatacccaaacttatgggacacaatgaaagctgtgctaagaggaaaactcatagcgctgagtgcctgcagaaagaaacaggaaagagcatatgtcagcagcttgacagcacacctaaaagctctagaacaaaaagaagcaaatacacccaggaggagtagaaggcaggaaataatcaaactcagagctgaaataaaccaagtagaaacaaaaagtaccatagaaagaatcaacagaaccaaaagttggttctttgagaaaatcaacaagatagataaacccttagccacactaacgagaggacacagagagtgcgtccaaattaacaaaatcagaaatgaaaagggagacataactacagattcagaggaaattcaaaaaatcatcagatcttactataaaaacctatattcaaaaaaacttgaaaattttcaggaaatggacaatttcctagacagataccaggtattgaagttaaatcaggaacagataaaccagttaaacaaccccataactcctaaggaaatagaagcagtcattaaaggtctcccaaccaaaaagagcccaggtccagacgggtttagtgcagaattc

SEQ ID NO: 4406 - DNA, 958 bp, Rattus norvegicus
  Genbank Accession No. X06107
cgaatgttcccccagctgtttcctgtctacagtgtctgtgttttgtagataaatgtgaggattttctctaaatccctcttctgcttgctaaatctcactgtcgctgctaaattcagaccagatagagcctgcgcaatcgaaataaagtcctcaaaattgaaatgtgactttgctctaacatctcccatctctctggattctttttgcctcattattcctgcccaccaattcatttccagactttgtacttcagaagcgatggggaaaatcagcagtcttccaactcaattatttaagatctgcctctgtgacttcttgaagataaagatacacatcatgtcgtcttcacatctcttctacctggcactctgcttgctcacctttaccagctcggccacagccggaccagagaccctttgcggggctgagctggtggacgctcttcagttcgtgtgtggaccaaggggcttttacttcaacaagcccacaggctatggctccagcattcggagggcaccacagacgggcattgtggatgagtgttgcttccggagctgtgatctgaggaggctggagatgtactgtgctccgctgaagcctacaaagtcagctcgttccatccgggcccagcgccacactgacatgcccaagactcagaagtcccagcccctatcgacacacaagaaaaggaagctgcaaaggagaaggaaaggaagtacacttgaagaacacaagtagaggaagtgcaggaaacaagacctacagaatgtaggaggagcctcccgaggaacagaaaatgccacgtcaccgcaagatcctttgctgcttgagcaacctgcaaaacatcggaacacctgccaaatatcaataatgagttcaataccatttcagagatgggcatttccctcaatgaaatacacaagtaaacattccgacattgtctttaggagtgtttgtt

SEQ ID NO: 4407 - DNA, 1361 bp, Rattus norvegicus
  Genbank Accession No. X06801
ccagccagtcgccatcaggaacctcgagaagctgctccagctatgtgtgaagaggaagacagcacagctctggtgtgtgacaatggctccgggctctgtaaggcgggctttgctggtgatgatgctcccagggctgttttcccatccatcgtgggacgtcccagacaccagggagtgatggttggaatgggccaaaaggacagctatgtgggggacgaagcgcagagcaagagagggatcctgaccctgaagtatccgatagaacacggcatcatcaccaactgggacgacatggaaaagatctggcaccactccttctataacgagcttcgcgtggccccagaggagcatccgaccttgctaacggaggcgccgctgaaccctaaggccaaccgggagaaaatgacccagattatgtttgagaccttcaatgtccctgccatgtatgtggctattcaggctgtgctgtccctctatgcttctggacgtacaactggtattgtgctggactctggagatggcgtgactcacaacgtgcctatctatgagggctatgctctgcctcatgccatcatgcgtctggacttggctggccgagatctcaccgactacctcatgaagatcctgactgagcgtggctattccttcgtgactactgctgagcgtgagatcgtccgtgacatcaaggagaagctgtgctatgtcgctctggactttgaaaatgagatggccactgctgcttcctcttcttccctggagaagagctacgaactgcctgatgggcaggtgatcaccatcgggaatgaacgcttccgctgcccggagaccctcttccagccatctttcattggaatggagtcggcgggcatccacgaaaccacctataacagcatcatgaagtgtgatattgacatcaggaaggacctctatgctaacaacgtcctctcggggggcactaccatgtacccaggcattgctgacaggatgcagaaggagatcacagccctcgctcccagcaccatgaagatcaagattattgctcctccagaacgcaaatattctgtctggatcggcggctccatcctggcttctctatctaccttccagcagatgtggatcagcaaacaggagtatgacgaagctggcccctccattgtccaccgcaaatgcttctaagtcacgcccccaccctccgccccgcccccacccccgccccgcccccgctctgtctctagcacacaactgtgaatgttttgtggatcagcgccttcagttcttttccaaatcattcctacctaaagctttgatttgttactcgtgtgtttttttttaataaatcagacatgtgctacccttctaaa

SEQ ID NO: 4408 - DNA, 2134 bp, Rattus norvegicus
  Genbank Accession No. X07259
cgctgcaccatgagcgtctctgcactgagctccacccgcttcacgggcagcatctctggcttcctccaagtggcctccgtgcttggtctgcttctgctgctggtcaaagcagtccagttctacctgcaaaggcaatggctactcaaggctttccagcagttcccatcacctcccttccactggttctttgggcacaagcagtttcaaggtgacaaagaactacagcaaattatgacatgtgtggagaatttcccaagtgcctttcctcgatggttctggggaagcaaagcctacttaattgtctatgaccctgactacatgaaggtgattctcgggcgatcagatccaaaggccaatggcgtctacagattgctagctccttggatcggatatggtttgctcttgctgaatggacaaccgtggttccagcaccggcgaatgctaaccccagccttccactatgacattctgaaaccctatgtaaaaaacatggctgactccattcgactgatgctagacaaatgggaacagctggcaggtcaagactcctctatagaaatctttcaacatatctccttaatgaccctagacactgtcatgaagtgtgccttcagccacaatggcagtgttcaggtggatggaaattacaagagctatatccaggccattgggaacttgaatgacctctttcactcccgtgtgaggaacatctttcatcagaatgataccatctataatttttcttccaatggccacttgttcaaccgtgcttgtcaacttgcccatgatcacacagatggtgtgatcaagctaaggaaggatcagctgcagaatgcgggagagctggaaaaggtcaagaagaaaagacgtttggattttctggacatcctcttacttgccagaatggagaatggggacagcttgtctgacaaggacctacgtgctgaggtggacacatttatgttcgagggtcatgacaccacagccagtggagtctcctggatcttctatgctctggccacacaccctaagcaccaacaaagatgcagagaggaagttcagagtgtcctgggggatgggtcctccattacctgggatcacctggaccagattccctacaccaccatgtgtatcaaggaggccctgaggctttacccacctgttccaggcattgtcagagaactcagcacatctgtcaccttccctgatgggcgctctttacccaagggtatccaagtcacactctccatttatggtctccaccacaacccgaaggtgtggccaaacccagaggtgtttgacccttccaggtttgcaccagactctccccgacacagccactcattcctgcccttctcaggaggagcgaggaactgcattgggaaacaatttgctatgagtgagatgaaggtgattgtggccctgaccctgctccgctttgagctactgccagatcccaccaaggtccccatccccttaccacgacttgtgctgaagtccaaaaatgggatctacctgtatctcaagaagctccactaattccggacttcttcattataccaataatcaacggtcacaaccttgatggtcgggaataacaggacgttattatcttacagttgtggagctccgaaatctgaaatgagtttcactggcagaaagctgagttggtggtgtgactagccttcttcagaagagtgcttcagagagtcctctcctcctctcttcagtacagatcacccttctcagcactggaatattcctctgctttaaagccagcacccttcccataccccctcttctaaaagccttcccttttacaaatgttcttatgacatcatcaagaccactgaaaaactccaagataatttcccatctcaatattccttactccatctaacctactaagtcccttttgaattatgaggaataattcaatttgttccatgggctccaaaactcaaggcctgagcattattgtgaaacctttattcagcctaatatcatcttcacaagactgttacctggtacgttcatctaaatctcccctgcatagtctctctacctgactattcctcacacaagtttctttaccttccctcctttctccaataaagtgtccagtgtcctgcac

SEQ ID NO: 4409 - DNA, 2971 bp, Rattus norvegicus
  Genbank Accession No. X07266
cggcggccgagtgcgaggcagagagcgagatctgtacggtgtgcgagcgagggcgatcacagcctgcgaacaagcaaagaaagagagcgagtgagcggcgaggcgcctgcgcgatgctcgggcccctgagcccgcggccctgagctagccgggacggacatgcgcgggagggcgccgcggggccccgctcccctgggggaatgaaagctactggttgacttaagagcacctggccttcacagattcgtggccatcccagggtgggcacaatgtcaacagcaggagttgctgctcaggatattcgagtcccattaaaaactggatttctccataatggccaggctttggggaatatgaagacctgctggggcagtcgcaatgagtttgaaaagaattttttaaatatcgatccaataaccatggcctacaatctgaactcccctgctccggagcatctaacaaccctcggatgtgcttctccgtccgctccagggagcggtcacttctttgcagagcgtggtccatctccaaagtcaagcttgccccctcttgttatcccaccaagtgaaagctcgggacagcgtgaagaggatcaagttctgtgtggttttaagaaactctcagtgaatggggtgtgcgcttccacacctccacttacacccattcaaagctgctcttccccgtttccctgtgcagctccctgtgatcgcagttcccgaccgctcccaccattgcccatctctgaggacccatctctggatgaggccgactgtgaggtggaatttctaaccagtgcagatacagacttccttttagaagactgcgtgccttccgatttcaaatacgatgttcctggcaggcgaagcttccgtgggtgcggacagatcaattatgcgtattttgacagcccaactgtttctgtggcagatcttagctgtgcatctgaccagaacagagttgttccagatccaaaccctcccccgcctcaaagccatcgcagattaaggaggtctcactcaggaccagccgggtcgtttaacaagccagccatccggatatctagctgcacacacagagcctctcctagctcggatgaagacaagcctgagatcccgccccgggttcctatacctcccaggccagccaagccagactacagaaggtggtcagcagaagtgacctctaacacatacagtgatgaagataggcctcccaaagtccccccgagagaacctttgtctcggagtaactcccgtaccccaagtcctaaaagccttccgtcttacctcaatggggtcatgcctccaacacagagctttgcccccgaccccaagtatgtcagcagcaaagccctgcagagacagagcagcgaagggtctgccaaggccccctgcatcctgcccatcattgagaatgggaagaaggtcagctccacgcattattacctactacctgagagaccgccataccttgacaaatatgagaagtattttagggaagcagaagaagcaaacccaagcacccagattcagccattacctgctgcctgtggtatggtctctgccacagacaagctggcctccagaatgaaaatggatgtgggcggccacgggaagcgcaaacacttatcctacgtggtttctccgtagatatggggtcatggttcaacagaagttacatggaacggatggctgccaagtttccaatttgaggttcatagaacagtgtcaagtggcaacatgaagtggtggactctgccttggtgaggaaggcatagagccgttatgaggtgctgttgtgctgggagtccctgacctatcagcataggaagaaaaaagtatgatttaaagatgtgctagagggacacttttacatttgactacattatatacctatgtataaacgtgcggtgtaaccatagaccatagctgcaggataaccaattagtcactctagagtaatctatattcagaacaattcaaacgagctggaggcacagctccagacagtgtgaaaattgagcaaacgggagagagcagtactgttgatcagttataaatgtagagattcctggcattcaggcctgctatctagtttgttttcttccccttccctgccagcagtcttctccatacacgacagggcgtgctcttcgccaggcctgtaacgtcttgttgaaatcgttctatggcctaatacttgccgctctgggcgtttgtcttgagaggagaggacagccgtttctggaccatgttatctatcacctgtgtatgtctctcttggaaatggacagaattggtgacttttccatgctattcctgcttttcccgtccactgaagaggctttcaagagtgcagttgagtggtgctggccgtcagtgttgggtataagttttatagaccagcccagtgattagccatgattgagagttatcgtggggtgtatgggatgttgttttgtttttgagactttaaagtacaacacaagctggtcttgtgttgttggttcctattcagtatttcctggggattgtttgctttttaagtgaaacacttctgaccaatagcacagaacgtcttaatgccagaggtcacttcagcatcttcctgcttagaaaactcacagctggctgcctcactgccctgagagtcagtgagacgcatagcttgtgttcaatttttacatcctctgattgtttatcttgtatagataagcacaaagagaaggtgcttgctaacagagggacaccgctgccatgtcccaacaagctgttcagtttaaactgctgaatgacattatttgagctatttaaagcttatttttagtatgaactaaatgaaggttaaaacatgctttagaaaatgcactgatctccgcactgtgtgtacagtattggacaaaggatttgttcattttgttgcattattttgaatattgtcttttcattttaataaagttatattacttatt

SEQ ID NO: 4410 - DNA, 2170 bp, Rattus norvegicus
  Genbank Accession No. X07648
ccacgcaggatcacgatgctgcccagcctggcactgctcctgctggccgcctggacggttcgggctctggaggtgcccactgatggcaatgccggtctgctggcagaaccccagatcgccatgttctgtggtaaactcaacatgcacatgaatgtgcagaatggaaaatgggagtcagacccatcagggaccaaaacctgcattggcaccaaggagggaatcctgcagtactgccaagaggtctaccctgaactgcagatcacaaacgtggtggaagccaaccagccagtgaccatccagaactggtgcaagcggggccgcaagcagtgcaagacgcacacccacatcgtgattccttaccggtgcctagttggtgagtttgtaagcgatgcccttctcgtgcccgacaagtgcaagtttctacaccaggagcggatggacgtttgtgagacccatcttcactggcatactgttgccaaagagacatgcagtgagaagagcactaacttgcacgactatggcatgctgctgccctgtggcatcgacaagttccgaggggtcgagttcgtgtgctgcccgttggcggaggagagcgacagcatcgattctgcggacgcagaggaggacgactccgatgtctggtggggtggagcggacacagactatgctgatggcggtgaagacaaagtcgtagaagtagccgaagaggaggaagtggccgatgttgaggaagaagaagctgaggatgacgaggatgtggaggatggggatgaggtggaggaggaggccgaggagccctacgaagaggccacagagagaacaaccagcattgccaccactaccacaactaccactgagtctgtggaggaggtagtccgagttcccacgacggcagccagcacccctgacgcagtcgacaagtacctggagacccccggagatgagaacgagcacgcccatttccagaaagccaaagagaggttggaagccaagcaccgagagagaatgtcccaggtcatgagagaatgggaggaggcagaacgtcaagccaagaatttgcccaaagctgacaagaaggccgttatccagcatttccaggagaaagtggaatctctggaacaggaagcagccaacgagaggcagcagcttgtagagacacacatggccagagttgaagccatgctcaatgatcgccgtcgcctggccctcgagaattacatcaccgcactgcaggcggtgcctccaaggcctcatcatgtgttcaacatgctgaagaagtacgtccgtgcagagcagaaggacagacagcacaccctaaagcattttgaacatgtgcgcatggtggaccccaagaaagctgctcagatccggtcccaggttatgacacacctccgtgtgatctacgagcgcatgaaccagtctctgtccctgctctacaacgtccctgccgtggctgaggagattcaagatgaagttgacgagctgcttcagaaggagcagaactactccgacgacgtcttagccaacatgatcagtgaacccagaatcagttacggcaacgatgctctcatgccttctttgactgaaacgaagaccactgtggagctccttcccgtgaatggcgaattcagcctggatgatctccaaccgtggcatccttttggggtggactctgtgccagccaatacagaaaatgaagttgagcctgtcgacgcccgccccgctgctgaccgaggactgaccactcgaccagggtctgggttgacaaacatcaagacagaagagatctcagaagtgaagatggatgcggagttcggacatgattcaggcttcgaagtccgccatcaaaaactggtgttctttgcagaagatgtgggttcaaacaaaggtgccatcattggactcatggtgggtggcgttgtcatagcaacagtgattgtcatcaccttggtgatgctgaagaagaaacagtacacatccatccatcatggcgtggtggaggttgacgctgctgtgaccccggaggagcgccacctctccaagatgcagcagaatggatatgagaatccaacatacaagttctttgagcagatgcagaactaaaccccgccccccgccacagcagcggcctctgaacttgacagcaaaaccattgcttcactacccatcg

SEQ ID NO: 4411 - DNA, 4144 bp, Rattus norvegicus
  Genbank Accession No. X07729
gaattctactcttgtctccctaggtagcctctctccacagaccctattcacacaccccctccaatagtccccctccttccactctggcttttttcacccgccttccttcacacctatctctcctacttaaaatctcactggatctgtctttagctttggagctggtgaaggaagccattgacaaggctggctacacggaaaagatggtgattggtatggatgtggctgcctctgagttttaccgcgatggcaaatacgacttggatttcaagtctcctgctgacccttcccgatgcatcactggggaccagcttggggcactctaccaggactttgtccggaactatcctggtgagagtgagggattctgggagataggaaagggaaagaacggagataggcagaggtgaactttatggggtgcagagtctggggcctggtgacgtcctgaagcagggagaagaggcagtaggttcttacaatgcagacctttgagactgtgcatgcaactgtgactgggctcctccgcctcgtttcagaccctgggctctgagagctacttgagtcctagggaaagcactggaaggagtcggggatgggaagaacatgagtggaggtgacagaaaagtgccaggctttagtatccttgattgatgaagatagatactgaatggagtcagcgcggctgcctggggcggggcagggaggggatcactgaggtacagagtctccacagctacaaagggcctccatcctgcttcgtggaggcagttggcctccatcatagcaggcttctctgggaagaaccagccccctctccacaccctctgcagtggtctccattgaagacccattcgaccaggatgactgggcagcttggtccaagttcacagccaatgtcggcatccagatagtgggtgatgacctgacggtgaccaaccccaagcgcatcgagcgggcagtggaggagaaggcctgcaactgtttgctgctcaaggtcaaccagatcggctcagtcacagaagccatccaagcgtgagtggcttctggcctcctcccaccttgtgtcttcaggactcctcttgagagccccccctagctggattctgccctggaactctggtgaacactggctacccttcacactgttctcacttctagtctcttcattcttcacgatctgccctcacgcccctaagtcaccttccaccaggtgcattcctgacatagatcaagcccggggctgggagggaagagctgtgcttcagggcaggtcagtgctggtgtctgctccaggtgcaagctggcccaggagaacggctggggggttatggtgagtcatcgctctggagaaaccgaggacacgttcattgcagacctcgtagtgggactgtgtacaggtcaggtgagtagagccagtccgagggatcaggagagatctttgtggggttagtgggttctgggcccaggtagttactgtcctgccaaaaaaaaatctgagtcagaaaagtttcaagagtagaagtctggccaggcgtagtggtgcacacctttaatcccagcactcaggaggcagaggcaggtggatctctgtgagtttaaggccagtttggtttatatagtgagtttcaggacagtcagggctacactgagggactccttaacaaacgaagacgtgaaaagagtagaagttccgagctggtgagatggcccaggaggttcaagtgcccggtgctaagcctgactgctagcttcagtttgattcatgggacccacaggttagaaggagagaaccaactcccaccagttgtcctctgaccttccaatgcacaccaggcaagagcagacccacagacatgcatacagacatgaaataaagtattaatttttataattaattaattaataattaatagatacaaatgcagatgtttcagggctggaggcttagctcagttgcaggtacttcccacatgcgcaagaccctgggttccattaaaaaaaggggaggggggaggtagggtatgacctgcatgcctttagtcctagcactcaggagacagaggaaggaggatttctatgaattcaccagcctagtctacttagcgagttctaggacggctatagtaaaattctgtcccacaaaaacaaaaaatagacctggacttggggtcacatcctttagccccaacacttcgggaagtagaagcaggaggatcaggagttcagggctaacctgtcccatttgaggccaactttcataaaattgtctcaaaataaaaaaaagtgtgtgtgtgtgtgtgtgtgtgtgtgtgtgtgtgtgtgtgtgtgtgttgtgttgggggtaaaggggagcaaggttgttctatcaggtgaaggagatctttaaacggcatatcttctggaatgtttcagatcaagactggtgccccatgcagatctgaacgtctggcgaagtacaaccagctcatgaggtgaggagggtccctgaggaacaagaacccgagacccagagctgaacaccctattaggccaccattccatctcttgcatccaggagctggatagtactggctgccaagaaaatggttttgtttagtgggttcaagggtggtgtgactgacagatcactaacgtacctgaaaaccagggaatgttcaccttggggcagtcctcaagggaggagcctggcgggatccagagagaaaagcagatctcctctcccctccctccccctccccatgctccattccggttcatcgtcaggattgaagaggagttgggggaggaggctcgcttcgcgggacacaacttccggaatcccagtgtgctgtgaccccctgcttgcctgaacaccggaacatcatctcattctcctggagcctctttcttgctgtcccgacccgccatagttaccttgataccttgagccccaagtcacccagaacacctcgactcacctgctctggctgttcttggcttccacaaccccttgctgtctcctactcttcctcctctctgggccccatttttggggggattccagtatgcccactttcccttctattctctctaatcttaaaaaaaaaaaaaaaatgacgactagaagaagcggtccacagaagaaccgccagcgtccgacaggagcttcaggattggtgtgttggggcgtttaaagtggggccacgtggcacgtgtgcttccctgccatccatggtgtgttaagccttgaactatgcacagagctggtgtttggggagtgctggatgtgtgtgtgttcacatttgtttgtttgtttatttatttattcacttatttatttctcagcctgtcagtcgtctgccattactcttacagtctgaaagcatcagtattttcacgtggttccatttcaagatgacctaggatgggaggttttgttagcatgggaaaggtcacagaaaggttagcaatggtttttcatttggtgcactaactgaagctcggtactttacagaatggggctgtgtacccggggacttttctcctataactctctcccccagccctaggttcctcagtctttttctccggctgcaccagagcgctgcctcattcccccgtgccatgtcccacagttgccactgtctctgtggctttgaaatgaccaccactattaaagtctgaaccacagtgcacaccaccccttgtctgaggacttttactctttgctccatatgagaggaggaagagaaaggactggatattggtgaacctagagagcagatctggggagggcaagtcactgaactcatgaccaagtttgcagcattgctggctatgtggaacccatggtaaaaaatcccccaaagacagggtttctctgtgaagccctggctgtcctggagctcaccctgtagaccatgctggccccaaacctatagtgattagcctgcctctgcctctgggtgctgggattaaaattgtgtactgccacacctgaccaaactaaggactcttaacctgtgatacaggagtccctcaaacatcagggattgagtgtatctggagtgaggaataaggcatttctggttcccaaagtctttgagggaagaagggataaagtggtagactagcattcctgtacgggtcctcaacagaattc

SEQ ID NO: 4412 - DNA, 1495 bp, Rattus norvegicus
  Genbank Accession No. X12459
caatccaagacaagatgtccagcaagggctctgtggttctggcctacagtggtggtctggacacctcctgcatcctcgtgtggctgaaggaacaaggctatgatgtcatcgcctacctggccaacattggccagaaggaagactttgaggaagccaggaagaaggcactgaagcttggggccaaaaaggtgttcattgaggatgtaagcaaggagtttgtggaagagttcatctggcctgctgtccagtccagtgcactctatgaggaccgctatctcctaggcacctctctcgccaggccttgcatagctcgcaaacaagtggaaattgcccagcgcgaaggggccaagtatgtgtctcacggcgccacggggaagggcaatgaccaggtccgctttgagctcacctgctactcgttagcaccccagattaaggtcatcgccccctggaggatgcccgagttttacaaccggttcaagggccgaaatgatttgatggaatacgcaaagcaacatggaatccccatccctgtcacccccaagagcccctggagcatggatgagaaccttatgcacatcagctacgaggctggaatcctggaaaaccccaagaaccaagcacctccaggtctctacacaaaaactcaggaccctgccaaagcacccaacaccccagatgtccttgagatagaattcaaaaaaggggtccctgtgaaggtgaccaacgtcaaagatggcactacccacagcacatccttggacctcttcatgtacctgaatgaagttgcgggcaagcatggagtagggcgcattgacatcgtggagaaccgcttcattggaatgaagtcccggggtatctacgagaccccagcagggaccatcctttaccacgctcatttagacatagaggccttcaccatggatcgggaagtacgcaaaatcaagcagggcctgggcctcaaattcgcagagctcgtatacaccggtttctggcacagccctgaatgtgaatttgttcgccactgcatcgacaagtcccaggaacgggtggaaggaaaggtgcaggtatctgtcttcaagggccaggtgtacatccttggccgggagtctccactttcactatacaatgaagagctggtgagcatgaacgtacagggtgactatgaacccattgatgccaccggcttcatcaatatcaactcgctcaggctgaaggagtaccatcgccttcagagcaaggtcaccgccaaatagaccgtgacaaagaggccgggcctccccgctctgcagctctcccaggctccagcattaattgttgtgataaatttgtaattgtagcttgttctcctaccacctgactggggctgctgtgccccccctcacctcccccccacccacaggctttgttccctggtcccctatagcctacaaaagtggtcatcgaagggaagggggggtggcaggcagctgcagaaagcgcgtaaaatgacaattaa

SEQ ID NO: 4413 - DNA, 3037 bp, Rattus norvegicus
  Genbank Accession No. X13722
ttgacccagtgcggcgtaggattgcagcccgcatacctggggcttgccacccaggttttgcagctgagacaccgtgggacccgtgatcctgtgtttgcagcgggaacatttcgggtctgtgatccgagtggggacgcgacgcagaggctgaggatgagcaccgcggatctgatgctacgctgggccatcgccctgctcctggctgctgctggagttgcagcagaagattcatgtggcaagaacgagttccagtgtagagacggaaaatgcatcgtcagcaagtgggtgtgtgacggcagccgcgagtgcccggatggctccgatgagtcccctgagacatgcatgtctgtcacctgtcgatccggtgagttcagctgtggaggccgcgtcagccgatgcattcctgactcctggagatgtgatgggcggaccgactgtgaaaatggctcggatgaactagactgctcccccaagacgtgctccctggatgagttccgctgccaggatggcaagtgcatctcccggcagtttgtgtgtgaccaagactgggattgcctggatggctctgacgaggcccactgtgcggccaccacttgtggccctgctcacttccgctgcaactcctcttcctgcatccccagcctgtgggcctgcgacggggaccgggactgtgacgatggctccgatgagtggccgcagaactgcggggccgaagacacggccgctgaggtggtcagcagcccctgctcctccctcgagttccactgtggcagtagtgagtgtatccatcgcagctgggtctgtgacggtgcggctgactgcaaggacaagtcggacgaggagaactgcgcggtgaccacctgccgacctgacgaattccagtgtgcagatggctcctgtattcacggtagccgccagtgtgaccgtgaacatgactgcaaagacatgagcgacgagcttggctgcatcaatgtgacccagtgcgatggccctaacaaattcaagtgccacagtggggagtgcatcagcttggacaaggtgtgcaactccgcccgggactgtcgtgactggtcggatgagcccatcaaggagtgcaagaccaacgagtgcttggacaacaatggtggctgttcccacatctgcaaggacctcaagattggctatgagtgcctatgtcccagcggtttccggttggtggacggccaccagtgtgaagatattgacgagtgtcaggagccagacacctgcagccagctctgtgtgaacctggagggcagcttcaagtgcgagtgtcgggccggcttccacatggaccctcacaccagggtctgcaaggctgtgggttccatagggtttctgctcttcaccaaccgccatgaggtacgtaagatgaccctggaccgcagcgagtataccagcctgatccccaacctgaagaatgtggtggcgctggacactgaggtggccaacaatagaatttactggtctgacctgtcccagagaaagatctacagcgccgtgatggaccagggcaccagcttgtcctatgatgccatcatcagtggggacctgcacgcccctgacgggctggcggtagactggatccatggcaacatctactggacggattcagttccgggcactgtttccgtggctgacaccaagggtgtcaggaggagaactctgttccgagagaaagggtccagacccagagccatcgtagtggaccctgtgcatggcttcatgtactggacagattgggggacacctgccaagatcaagaaagggggtttgaatggtgtagacatctactctctggtgaccgaggacatccagtggccaaatggcatcacactagatcttcccagtggccgcctctattgggttgattccaaactccactccatctccagcatcgatgtcaatgggggtggtcggaaaaccattttggaggatgagaagcagctagctcaccccttctccttggccatctatgaggacaaagtgtattggacagatgtcttaaatgaagccattttcagtgccaaccgcctcacgggttcagatgtgaatttggtggctaaaaacctcatgtccccggaggacattgtcctgtttcacaacgtcacgcagcctagaggggtaaactggtgtgaggcaacggttctccccaacggtggctgccagtacatgtgcctgcctgcccctcagatcagtgcccactcacccaagttcacctgcgcttgccctgatggtatgctactggccaaggacatgaggagctgcctcccagaagtcgacactgtaccgaccacccaggggacatccaccattgggcctgtggtcaccacatcagctgctgtgtcactgaagcgcaaggaggatccctcagctactaggcacaaggaggatccctcagctactaggcacaatgaggatccctcagctaccagcacctctaggcagcctggggataccccagagctcagcacagtggagtcggtgacagtgtcctcccaagtccaaggtgacatggctggcagaggggacgaggtgcagcggcacggtgtggggttcttgtccatcttcctccccattgcactggtggccctccttgtcttcggagccatcctcctgtggaggaactggcggctgaggaacattaacagcataaactttgacaacccagtctaccagaagaccacggaggacgagatccacatttgccgcagccaggatggctatacctacccctcgagacagatggtcagcctggaggatgatgtggcatgaacagctgaggggagccatctctttccgggatccgctgccacccttaggcaggaaggacgctttctcacacctccccgccctgcactggtccttccacctcagtggtctctgtgttgctcaaagcaagataagagcaaaactgggctggggccaagctcagcggcctgtctgccctgggtcctgttttatatatttattgtctggggacagaaaaggctactggccatgctccagatgggaattc

SEQ ID NO: 4414 - DNA, 654 bp, Rattus norvegicus
  Genbank Accession No. X13905
ccgctgccgccatgaaccccgaatatgactacctgtttaagctgcttttgattggtgactcgggcgtgggcaagtcatgcctgcttctgcggtttgctgatgacacgtacacagagagctacatcagcaccattggggtggacttcaagattcgaaccattgaactggatggcaaaaccatcaaactacagatttgggacacagctggtcaggaacggttcaggacagtcacttccagctactatcggggtgctcatggcatcattgtggtgtatgacgtcactgaccaggaatcctacgctaatgtgaaacagtggctgcaggaaatagatcgctacgccagtgagaatgtcaataaactgctggtaggcaacaagagtgacctcaccaccaagaaggtcgtggacaataccacagccaaggaatttgcagactctctgggtgtccccttcctggagacaagtgccaagaatgccaccaatgttgaacaggcattcatgacaatggctgcagagatcaaaaaacggatggggccaggagcagcatctgggggtgaacggcccaacctgaagatcgacagcactcctgtgaaatctgctagtggtggctgctgctaggggggggtacttggggagggcacttctccagatgatg

SEQ ID NO: 4415 - DNA, 591 bp, Rattus norvegicus
  Genbank Accession No. X14181
cttttgtgagtggcagtgaacgagcacgcactgctatgaaggcgtcgggcacgcttcgggagtacaaggtggtggggcgttgcttgccaaccccaaaatgccacacaccgccactgtaccgaatgcgaatctttgcacccaaccatgtggtggccaagtcccgcttctggtactttgtgtcgcagctgaagaagatgaagaagtcatccggggaaattgtgtactgtgggcaggtgtttgagaagtcacccctgcgtgtgaagaacttcggcatctggctgcgctatgattcccgaagtggcactcacaacatgtaccgagagtaccgggacctgaccactgccggcgcggtcacacagtgctaccgagacatgggtgcccgacaccgtgcccgtgcgcactccatccagatcatgaaggtggaagagattgcagctggcaagtgccgccggccagctgtcaagcagttccacgactccaagatcaagttcccattgccccaccgtgtgttgcggcgccagcacaaaccacgcttcaccaccaagaggccaaacaccttcttctagacaccagagacccactgaataaaag

SEQ ID NO: 4416 - DNA, 907 bp, Rattus norvegicus
  Genbank Accession No. X14210
tctttccgttcccagcgcagcatggctcgtggtcccaagaaacatctgaagcgcgtagcggctccaaaacactggatgctggataagctgactggcgtgtttgctcctcgtccatccactggtccacacaaactgagggaatgcctgcctctgatcattttcctaaggaacagacttaagtatgccctgactggagatgaagtaaaaaagatttgcatgcagcgattcattaagattgatgggaaagtcaggaccgatataacctaccctgctgggtttatggatgtcatcagcattgacaagactggagagaacttccgtctgatctatgacaccaagggtcgctttgctgtccatcgaattacacctgaggaggccaagtacaagttgtgcaaagtgagaaagatctttgtgggcacaaaaggaatcccacatctggtgacccatgatgcccgtactattcgataccctgatcccctcatcaaggtgaatgacaccattcagattgatttggaaacaggcaagataactgatttcatcaagttcgacactgggaacctgtgtatggtgactggaggtgctaacttggggagaattggtgtaatcaccaatagggagagacatcctggctcttttgatgtggttcatgtgaaagatgccaacggcaacagctttgccactcgtctttccaacatttttgttattggcaagggcaacaaaccgtggatttctcttccccgaggaaaaggaatccgccttaccattgctgaagagagagacaagaggctagcagccaaacagagcagtgggtgaaatggtctctaggagacatgctggaggagtatttgtacctcaacacaacaagcctttctaagcaacatgctagattaaacagcatgatgaaatc

SEQ ID NO: 4417 - DNA, 508 bp, Rattus norvegicus
  Genbank Accession No. X14671
tccttttgcggccatcgctggattgcagccgccaaaatgaagttcaatcccttcgtgacttctgaccgaagcaagaaccgcaaacggcatttcaatgcaccatctcacattcggaggaagatcatgtcttctccgctttccaaagaactgagacagaagtataatgttcggtctatgcccattcgaaaggacgacgaagttcaggttgttcgaggacactacaaaggccagcagattggcaaagtggtccaagtgtacaggaagaaatacgtcatctacattgagcgagtccagcgagagaaggctaacggcacaactgtccatgtgggcatccgccccagcaaggtggttatcaccaggctaaagctggacaaggaccgcaagaagatcctggagaggaaagccaagtcccggcaagtaggaaaggagaagggcaaatacaaggaagaaactatcgagaagatgcaggagtagaaaaataatgcccagttttcattaaataaagctt

SEQ ID NO: 4418 - DNA, 16300 bp, Rattus norvegicus
  Genbank Accession No. X14848
gttaatgtagcttataataaagcaaagcactgaaaatgcttagatggattcaaaaatcccataaacacaaaggtttggtcctggccttataattaattggaggtaagattacacatgcaaacatccataaaccggtgtaaaatcccttaaagatttgcctaaaacttaaggagagggcatcaagcacataatatagctcaagacgccttgcctagccacacccccacgggactcagcagtgataaatattaagcaatgaacgaaagtttgactaagctagtacctctcagggttggtaaatttcgtgccagccaccgcggtcatacgattaacccaaactaattattttcggcgtaaaacgtgccaactataaatctcataatagaattaaaatccaacttatatgtgaaaattcattgttaggacctaagcccaataacgaaagtaattctaatcatttatataatgcacgatagctaagacccaaactgggattagataccccactatgcttagccctaaaccttaataattaaacctacaaaattatttgccagagaactactagctacagcttaaaactcaaaggacttggcggtactttatatccatctagaggagcctgttctataatcgataaaccccgttctaccttaccccttctcgctaattcagcctatataccgccatcttcagcaaaccctaaaaaggcactaaagtaagcacaagaacaaacataaaaacgttaggtcaaggtgtagccaatgaagcggaaagaaatgggctacattttcttttcccagagaacattacgaaacctttatgaaactaaaggacaaaggaggatttagtagtaaattaagaatagagagcttaattgaatagagcaatgaagtacgcacacaccgcccgtcaccctcctcaaattagattgacattcacatatacataatttcactaacaaatttatgagaggagataagtcgtaacaaggtaagcatactggaaagtgtgcttggaataatcacagtgtagcttaatcacaaagcatctggcctacacccagaagaattcataaaaaatgaacactttgaactaaccctagccctacaaccaaccaacataactaaacccccacataaactaaaacatttaactcaaaaagtattggagaaagaaatttacttaccaagagctatagagaaagtaccgcaagggaaatgatgaaagactaatttaaagtaaaaacaagacaaagattaaacctgtaccttttgcataatgaattaactagaaaatccttaacaaaaagaatttaagctaagaaccccgaaaccaaacgagctacctaaaaacaatttcatgaatcaacccgtctatgtagcaaaatagtgggaagatttttaggtagaggtgaaaagcctatcgagcttggtgatagctggttgcccaaaaaagaatttcagttcaaactttaagcttccatcagaacaacaaatcaaaatgtaaacttaaaatatagccaaaagagggacagctctttaggaaacggaaaaaaccttaaatagtgaataaacaactacaatcacttaaccattgtaggcttaaaagcaagccatcaataaagaaagcgtcaagccacatcatcttacacacacactaattccacaaacctcaaaaattccaaaattacaaattgggctaaatctatgatcctagtgaatactgttaatatgtgaacaagaaccaatccaccaagcacaagtgctaagacaaccggataaccattgttaattattgaatcataggcataacccaacaatagaattacctatccctaactcgttagcccaacacaggcgtgctttaaggaaagtttaaaaaagtaaaggaactcggcaaacacgaaccccgcctgtttaccaaaaacatctcctctagcataacaagtattagtggcatcgcctgcccagtgactaaagttccacggccgcggtatcccgaccgtgcaaaggtaggataatcacttgttccttaattagggactagaatgaatggctaaacgagggtccaaccgtctcttacttgcaatcagtgaaattgaccttccagtgaaggggcggactcataataaaagacgagaagaccctatggagctttaatttactaatttcaatttatataaaaaaacctaatgggcgaaaacaacaaaattatgaactaccaaatttcggttggggtgacctcggagaataaaaaatcctccgaatgattataaccgagtcggtaaccgtgtccgacccagtcaagtaatactaatatcttattgacccaattattgatcaacggaccaagttaccctagggtaacagcgcgacctatttaagagttcatatcgacaattagggtttacgacctcgatgttggatcaggacatcccaatggtgcagaagctattaatggttcgtttgttcaacgattaaagtcctacgtgatctaagtccggcaatccaggtcggtttctatctatttacaatttctcccagttacgaaaggacaagagaaatggagaccaaccaatcctaggcttccaaccaatttagaaaaacttaataaagtatatatgtacaataaataaccttagacccaagttattagggtggcagagccaagtaattgcgtaagacttaaaaccttgttcccagaggttcaaatcctctccctaatagtgtactttattaatatcctaacactcctaatcccaatcttaattgccataggccttctcaccctagtagaacggaaaatcctaggctacatacaattacgcaaaggccccaacaacgaaggcccatatggtaaactacaaccatttgcagatgccataaaactattcataaaagaacccatacgccctctaaccacctcaatatcactatttattatcgccccaaccctctcccttacactagctctaagcctatgaattcccttaccaataccccacccccttatcaacctcaacctaggcataccatttattctagccacatccagcctttcggtctactccattctatgatcgggatgagcctcaaattcaaaatactccctattcggagccctacgagccgttgcccaaaccatctcttacgaagtcacaatagccttatacctcttatccgtcctcctaataagcggctccttctccctacaaatacttatcactacacaagaacatatctgactattaatccccgcctgaccaatagccataatatgatacatttcaaccctcgcagaaacaaatcgagctcccttcgacttaacagaaggagaatcagaattagtctcaggctttaacgtcgaatacgccgcaggaccattcgccctattcttcatagccgagtacaccaacattattctaataaacgccctaacatcaattgtattcctaggccccttatatcatatcaattaccctgaattatactcaaccagcttcataacagaaacactacttctatccacaactttcctatggattcgagcatcctacccccgttttcgatatgaccaactaatgcacctcctatgaaaaaatttcctcccactaacactagcattctgcatatgatacatttccctgccaattttcctagcaggaattccaccctacacatagaaatatgtctgacaaaagagttactttgatagagtaaataatagaggtttaaatcctcttatttctaggacaataggaattgaacctacacctaagaattcaaaattctccgtgccaccaatacaccctatcctacatagtaaggtcagctaactaagctatcgggcccataccccgaaaatgttggttaaacccttcccgtactaataaatccaattaccctaaccattatttacttaaccacctttaaaggccgcctaatcacgacacttagcaccaacttaccaccaatatgagtaggattggaaataagccttttagctatcatcccacttctagccaacaaaaaaagcccacgatcaactgaagcagcaacaaaatattttctaacccaagctacagcctcaataattatcctactagtcatcatcctcaactacaaacaatcaggaatatgaacccttcaacaacaaaccaataacatactactcaacataatactcatttcactggccataaaacttggactagccccattccactactgactacccgaagtcacccaaggaattcccctacacattggattaatcttactaacatgacaaaaaattgctccactatcaattctataccaattttatcaactcctaaacccaactatcaccaccattctcgcaatttcatcagtctttgttggcgcctgaggaggacttaaccagacccaaacacgaaaaatcatagcatactcatcaattgcccacataggatgaataacagcaatccttccatacaaccctaacttaaccctcctaaacttaacaatttacatcctacttactgttccaatattcaattacatcataacaaactcagcaacaacaatcaacacactctcactcgcatgaaataaaactcccataatcctaaccatagcatccatcatcctcctatcactaggaggactcccccctctcacaggatttttaccaaaatgagcaattatctccgagcttctaaaaaacaactgctcaaccctatcaacactaatagctatcatagccctattaagcctattcttctatactcgactaatttactctatatccctcaccacattcccaaccaacaacaactccaaaataatctcccaccaccaaaacccaaaacataattttatcctcccaaccctcacagtattaagtaccctaaccctaccgctttcctcccaactaatcacatagaagtttaggatatacagttcaagagccttcaaagcccttagaaaacaaacaagtttaacttctgataaggactgtaagactatatcttacatctgttaaatgcaaatcaactgctttaattaagctaaatcctcaactagattggaaggaatcaaattcctacgaaaatttagttaacagctaaataccctacttactggcttcaatctacttctcccgcctatcagaaaagaggcgggagaagccttagtagaggagattctctacaccttcgaacttgcaattcgacatgataatcaccttaaggctttttggtaaaaagggggctcaacccctgtctttagatttacagtctaatgcttactcagccattttacctatgttcgtaaaccgttgactcttttcaactaaccacaaagatatcggaaccctctacctattatttggagcctgagcaggaatagtagggacagctttgagtattctaattcgagctgaactaggacagccaggcgcactcctaggagatgaccaaatctataatgtcatcgtcacagcccatgcattcgtaataattttctttatagtaatacctataataattggaggcttcggaaactgacttgtaccactaataattggagcccctgatatagcattcccacgaataaataacataagcttttgactgcttcctccatcatttctactccttttagcatcctccatagtagaagctggagctggaacaggatgaacagtatatccccccttagccggaaacctagcccatgctggggtatccgtagatttaactattttttccctccacctagccggggtgtcttctatcttaggagctatcaactttatcaccactatcattaatataaaaccccctgctataacccaatatcagacacctctctttgtatgatccgtactaattacagccgtcctactacttctctcactgccagtattagcagcaggtatcactatactccttacagaccgaaatctaaatactactttcttcgaccccgctggaggtggagacccaattctttatcaacacctattctgattcttcggccacccagaagtgtacatcttaattcttccagggtttggaattatttcacatgtagttacctattactctggaaaaaaagaacccttcggatatataggtatggtatgaaccataatatctattggcttcctaggatttattgtatgagcacatcacatattcacagtaggcctagatgtagacacccgagcctactttacatctgccactataattatcgcaattcctacaggcgtaaaagtattcagctgactcgctacactacatggaggaaatatcaaatgatcccccgccatattatgagccttagggtttatcttcttattcacagtagggggcctaacagggatcgtactatctaactcatcccttgacattgtacttcatgatacatactacgtagtagctcacttccactatgtcttatctataggagcagtattcgccatcatagctggcttcgtccactgattcccactattctcaggctataccctaaatgacacatgagcaaaagcccactttgccattatatttgtaggtgtaaacataacattttttcctcaacacttcctaggattagcagggatacctcgtcgttactctgattatccagatgcttataccacatgaaatacagtctcctctataggctcattcatctcacttacggccgtccttgtaatgatcttcatgatttgagaagccttcgcatcaaaacgagaagtgctctcaatttcctactcttcaactaacctagaatgactgcatggatgccccccaccttaccacacattcgaagaaccttcctatgtaaaagttaaataagaaaggaaggaatcgaccccctacaactggtttcaagccaatttcataaccattatgtctttctcaatgagatattagtaaaataattacataaccttgtcaaggttaagttatagacctaatcctatatatcttacatggcttacccatttcaacttggcttacaagacgctacatcacctatcatagaagaacttacaaactttcatgaccacaccctaataattgtattcctcatcagctccctagtactttatattatttcactaatactaacaacaaaactaacacacacaagcacaatagacgcccaagaagtagaaacaatttgaacaattctcccagctgtcattcttattctaattgcccttccctccctacgaattctatacataatagacgagattaataacccagttctaacagtaaaaactataggacaccaatgatactgaagctatgaatatactgactatgaagacctatgctttgactcctacataatcccaaccaatgacctaaaaccaggtgaacttcgtctattagaagttgataatcgggtagtcttaccaatagaacttccaattcgtatactaatctcatccgaagacgtcctgcactcatgagccatcccttcactagggttaaaaaccgacgcaatccccggccgcctaaaccaagctacagtcacatcaaaccgaccaggtctattctatggccaatgctctgaaatttgcggctcaaatcacagcttcatacccattgtactagaaatagtgcctctaaaatatttcgaaaactgatcagcttctataatttaaactcattgcgaagcttagagcgttaaccttttaagttaaagttagagacaacaaatctccacaatgacatgccacaactagacacatccacatgatttattacaatcatctcctcaatagccacactatttattttatttcaattaaaaatttcttcccaaacctttcctgcacctccctcacccaaaactatagccacagaaaaaacgaataacccttgagaatcaaaatgaacgaaaatctatttgcctctttcattacccccacaataataggtctaccaattgttgtgaccattattatgttcccatcaattctattcccatcatcagaacgcctaatcagcaaccgactacactcatttcaacactgactaatcaaacttatcatcaaacaaataatgttaattcacacaccaaaaggacgaacctgagccctaataattgtatccctaattatatttattggctcaaccaaccttctagggcttcttccccatacatttacccctaccactcagctatctatagacctaagcatagccatccccctatgagcaggagccgtaattctaggtttccgacacaaactaaaaaattctttagcccacttctcaccgcaaggaacccccatctcactaattcccatactaatcatcatcgaaactatcagcctatttattcaaccgatagcactagcagtacgactaacagcaaacattacagcaggccatctattaatgcatctaatcggaggagctaccctagtacttatagacatcagcccaccaaccgctacaattacatttattattctacttctacttacagtacttgaatttgccgtagccttaattcaagcctatgtattcacccttctagtcagcctgtacctacatgataacacataatgacccaccaaacccatgcataccatatagtaaacccaagcccatgaccactaacaggagccctatcagctcttctactcacatccggcttagtaatatgattccattacaactccacaattctcctatcattaggcctcctgacaaacatcctaactatatatcaatgatgacgagatatcatccgtgaaggaacataccaaggccaccacacccctattgtacaaaaaggcctccgatacggaataatcctgtttattgtctccgaagtattcttctttgccggatttttctgagcattttatcattccagcctagttcctacccacgacctaggcggttgctgacccccaacaggaatcacccctttaaatcccctagaagtaccccttctaaatacatcagtcctcttagcatcaggagtctcaattacatgagcccatcacagcctaatagaaggcaaccgaaaccatataaaccaagccctactaatcaccattctcttaggattatatttcactatcttacaagcctcagagtatttcgaaacatcattttctatctcagacggaatttacggctcaacattcttcatagcaacgggatttcatggcctccacgtaattattggctcaactttcctaattgtctgtctactacgacaactaaaattccacttcacatcaaaacatcatttcggatttgaagccgcagcatgatactgacacttcgtagatgtagtttgactattcctatacgtttctatctattgatgaggatcctactcccttagtataaacaatacaactgacttccaatcagttaattctgaaaaaactcagaagagagtaattaacctacccattatcatcacaattaacatcaccttatcctttatcctcatttcaattgcattctgattgcctcaaataaacttatactccgaaaaagcaaacccatatgaatgtggcttcgacccaacaagttctgcacgccttcctttttcaataaaatttttcttagtagccattacatttctactattcgacctagaaatcgccttactacttcccctcccatgagcgattcaaacaaccaataccactacaataatagcaactgcctttattttagtcactattttgtctcttggcctagcctacgaatgaacacaaaaaggactagaatgaacagaataattggtaattagtttaaataaaattaatgatttcgactcattagattatgataataatcataattaccaacaatgacatctgctttcctaaatttaactatagcctttacattatctctactaggtacttttatatttcgctcccacctaatatccactctcctctgcctagaaggaataatactatcactatttgtcataacttcaacatccacattaaactccaactccataatctccataaccatcccaattaccattctagtttttgcagcctgcgaagcagcagtaggtttagccttactagtaaaaatttcaaatacttacggaacagactacgtacaaaacctcaaccttctacaatgttaaaaattattttcccatctatcatactcctcccactaacatgactctcagccaacaaaaaaatctgaaccaatgtcacctcctacagctttctagtgagcctattaagcttatcactcctatgacaaaatgacgaaaattacctaaatttctcagttatattctcctccgatccattatccaccccactaatcattctaacaacttgactcctcccactaataatgctcgctagccaaaatcacataaaaaaagaaaatataatgcatcaaaaactttacatctcaatacttattagcctccaaattttactcatcataacattctccgcaacagaactaattttattttatatcctgttcgaggccactctaatcccaacactaattatcattacacgatgaggcaaccaaacagaacgcttaaatgcaggaatttatttcctgttttatacactaattggctccatcccactcttaattgccctcatttcaatccaaaactcaataggaacactcaacttcctaatcctttccctcacaacacaccccctaccctcaacatgatccaacaccattctatgactagcatgtataatagcatttataatcaaaataccattatacggagtccatctatgattaccaaaagcccacgtagaagctccaattgcaggctctataattttagcagcaattctcctaaagctagggggttatgggataatacgagtttccatcattctagaccccctaacaaaatctttagcctacccattcatcatcctctcattatgaggcataattataactagctcaatctgcctacgccaaacagatctaaaatcattaattgcttactcatcagtaagccatatagccctagtcatcacagccattataatccagacaccatgaagcttcatgggagccacaatactaataatcgcccacggcttaacctcatcactcttattctgcctagcaaacaccaactacgaacgaattcacagccgaactataattatagctcgaggattacaaataatctttccattgatagcaacatgatgactattagcaagcttagccaacctagcactaccacccctaattaacctcataggcgagttattcattgttatagcaacattttcctgatcgaacccctctatcatccttatagcaactaacattgtcatcacaggaatatactcaatatatatgattatcacaacccaacgaggaaaactaaccagccacataaacaacctccaaccttcccacacacgagaattaacactcatagctctacacattattcccctcatactattaacaatcaaccctaaactcatcacaggcctaacaatatgtagatatagtttacaaaaaacattagactgtgaatctaacaacaggaaatcaaattccttatttaccaagaaagtatgcaagaactgctaattcatgcacccatacctaaaacatatggctttcttacttttataggatagaagtaatccattggtcttaggaaccaaaaaccttggtgcaactccaaataaaagtaataaatataataacaatcctaatcctcataattcttgatttacttacaacaccaatcacattttcaataacaatcttaaccaaacttatgtacttccgtcatatgctcattacatcaattaaattctcattcctccttagcctcttacctttactactattcttccaccacaacacagaatacataattactaactgacattgactaactattaattctattaaacttactataagtttcaaaattgactatttctcaatcctattcctatcagtatccctattcgtaacatgatcaattatacaattctcttcatgatatatacactctgacccccacattaaccgattcattaagtacttaataatattcctgaataacatactaatcctaacctcagctaacaatctattccaactctttattggatgagaaggggtaggaattatatccttcttattaatcggatgatgatatggccttgcagacgccaacacagcggccctccaagcaatcctctacaaccgagtcggagacattggtttcatcctagctataacctgattctgcctaaacataaactcctgagaactccaacaaattttcttaaccaacaccaacaacaatctagtccctctcacaggactactaattgcagccacaggaaaatccgcccaattcggacttcatccatgactcccatcagctatagaaggcccaactcccgtctctgccctactacactcaagcacaatagttgtagcagggatcttcctaataatccgattccaccccctaacctcaaacaatagtactattataacagccatactatgtcttggtgcaatcaccacattattcacagcaatctgtgctctcacccaaaacgacatcaaaaaaatcgtagctttctcaacatccagccaactaggccttataatagtcacattagggattaaccaaccctaccttgctttcctccacatttgcacccatgcattcttcaaagccatattattcatatgctccggatcaatcatccatatcctcaacgatgaacaagacattcgaaaaataggcaatataataaaagcaataccattcacatcatcttgtctcattatcggaagcctagcccttaccggaatacctttcctcacaggattctattcaaaagatctcatcatcgaagccatcaacacgtgtaacaccaacgcctgagccctaataatcactttaatcgccacatccataactgctgtgtacagcatacggatcatctacttcgtcaccatgacaaaaccacgatactccccactaattactattaatgaaaacaacccaaacctcattaatccaatcaaacgcctagcattaggaagcatcctagcaggcttccttatctcactaaatattcctccaactaacattcaaattctcacaataccctgacatttaaaaataacagccctacttattacaatcctaggatttgccattgccctagaacttaacaatttaacactaaatctatcaataagcaaacccaccaaactatcatcattctcaacctccctaggctactacccaccaattataccccgaattattcctcaaaaaactctaaattctagctacaaattatccttaaacctactagacctaatctgatcagaaaagacaatcccaaaatcaacctcaatcacccaaacccaactatctaaaataatatccaaccaaaaaggactaatcaaactatatttcctatcatttctcatcactatttcactaatttttatcttacacacacttaatcccgagtgatttcaataataataaaaatccccgcaaacaatgaccacccagccaccactatcattcaagtagcacaactataaatagccgcaaccccaatccccccctccaacataaccccaacatcatcaatctcatacattaatcaatcgcctagactatcaaaatcaactaactccaccttattattcaaactaaacaagtagaacactaccaactccataaaaagccctaaaacaaaaaaactaaaaataaaccaattagaccctcaagtttccggatattcctcagtagccatagcagttgtatacccaaatacaaccaacatcccacccaaataaattaaaaatactattaaacctaaaaacgaacccccaaaccctaaaactattaagcacccaatacatccactaacaatcaatccaaacccaccataaataggtgaaggcttcaacgccaaccctagacaaccagtcaaaaacagtaaacttaaaataaacatataatttgtcattatttctacacagcatttaactgtgactaatgacatgaaaaatcatcgttgtaattcaactatagaaacatctaatgacaaacatccgaaaatctcaccccctattcaaaatcatcaaccactcctttatcgacctaccggccccatctaacatctcatcatgatgaaacttcggttctctactaggagtatgcctcatagtacaaatcctcacaggcttattcctagcaatacactacacgtctgataccataacagcattctcatcagtcacccacatctgccgagacgtaaactacggctgactaatccgatacctacaagccaacggcgcctcaatatttttcatctgcctattcctccatgtgggacgaggactatactatggatcctacactttcctagaaacctgaaacattgggatcatcctactatttgcagtcatagcaactgcattcatgggctatgtactcccatgaggacaaatatcattctgaggagctacagtaattacaaacctattatcagctatcccttacattgggactaccctagtcgaatgaatctgaggaggcttctcagtagacaaagcaaccctaacacgcttcttcgcattccacttcatcctcccattcattatcgccgcccttgcaattgtacatcttcttttcctccacgaaacaggatcaaataaccccacaggattaaactccgacgcagacaaaatcccattccatccatattatacaattaaagacctcctaggtgtatttatattactattattcctaataaccctagtactattcttcccagacctactaggagacccagacaattatacacccgctaaccccctcaacaccccaccccacatcaaaccagaatgatactttctctttgcctacgctattctacgctccattcccaacaaactaggaggggtcgtagccctaatcttatcaatcctaatcttagccttcctaccattcctgcatacctcaaaacaacgcagcttaacattccgcccaatcacccaaatcctttactgaatcctagtagccaacctcctagtcttaacatgaatcggaggccaaccagtagaacacccatttatcattattggtcaactagcctccatcagttatttttcaattatcctcattctcataccaatctctggaattgttgaagacaaaatgttaaaatgaaattaatgtcccgatagtataaaaattactctggtcttgtaaaccaaaaatgaagagtcagtcttctcaggacaatcaagaagaaggaactacctccccaccatcaacacccaaagctgatattctacttaaactacttcttgtcagtacataaaatgatatggacattaaaacatttatgtatatcgtacattaaattattttccccaagcatataagcatgtaatatatatctaatgatttaggacatacatttaaactcaactataaattcacaacaacatgtctattctcaaatacattaagataatgcttattagacatatctgtgttattagacatgcaccattaagtcataaacctttctcttccatatgactatccctgtccccaattggtctctatttctaccatcctccgtgaaatcaacaacccgcccactcgtccccctcttctcgctccgggcccattcgtcctgggggtgactatactgaaactttaccaggcatctggttcttacttcagggccatcaattggttcatcgtccatacgttccccttaaataagacatctcgatggtaacgggtctaatcagcccatgatcaacataactgtggtgatatacatttggtattttttaattttcggatgccttcctcaacatagccgtcaaggcatgaaggtcagcacaaagtcctgtggaaccttttagttaagggtcatttatcctcatagacaaagctcgaaagactattttattcatgtttgtaagacataaatatttataaatactgaaaaatctgtcaacaaacccccccaccccctacacctgaaacttcaatgccaaaccccaaaaacattaaagcaagaattaaataaaacaaaaagctacttaattcttaaaaggcttctccattctagtagaccacaaaattttaacttaaatcttagcattggtaaaatttcccgacacaaaatctttcctcctaactaaaccctctttacttgcctaccctcagaaaattccacatacaccaaa

SEQ ID NO: 4419 - DNA, 851 bp, Rattus norvegicus
  Genbank Accession No. X15013
cgagcggatgcccaaaggaaagaaggccaaggggaagaaggtggccccggcccccgccgtggtcaagaaacaagaggccaaaaaggtggtcaatcctttgtttgagaaaaggcctaagaacttcggcattgggcaggacatccagcccaaaagagatctcacgcgcttcgtcaaatggccccgctacatcaggctgcagcggcaaagagccatcctctataagcggctcaaagtacctcctgccatcaaccagttcacccaggccctggacaggcaaacagcgactcagctgcttaagcttgcccacaagtacaggccagagacaaagcaggagaagaagcagaggctgctggcccgcgctgagaagaaagctgctggcaaaggggacgtcccaactaagagaccacctgtcctccgagcaggggtcaatacagtcaccactttggtggagaacaagaaggctcagctggtggtgattgcccatgatgtagaccccattgagctggtggttttcctgcctgccctgtgtcgaaagatgggggtgccctactgcatcatcaagggaaaggccaggctggggcgcctggtccacaggaagacatgcaccactgttgccttcacacaggtgaactcggaagacaagggtgctctggctaagctggtggaagctattaggaccaattataatgacagatatgacgagatccgccgccactggggaggcaacgtcctgggtcctaagtctgtggctcgcattgccaagctggaaaaggcaaaggctaaagaactcgccactaagctgggttaaatgtacacttaagttttctgtacataaatataattacaaagtt

SEQ ID NO: 4420 - DNA, 977 bp, Rattus norvegicus
  Genbank Accession No. X15551
atctacaatgatttctccggcgctcatcttcttttctgccttcctctgccatgttgctattgcgggacggaggatgtggcccatcaacaccctgaaatgtacacccagagtgtgtccttttgccggaatcttagaaaatggagttgtacgctacacgacttttgaatatcccaacaccattggctttgcttgtaaccctgggtattatctgaacgggactagctcttctaagtgcacggaggaaggaaaatggagtccagaacttcctgtttgtgctcggatcacctgcccgccaccaccaattcctaagtttgcagcccttaaggaatacaagacttcagttgggaacagctctttttatcaggacacagtggtctttaaatgcttgccacactttgccatgtttggaaatgacacagttacgtgcacagcccatggaaactggacccaattgccagaatgccgggaagtaaaatgtcccttcccttcaaggccagacaatgggtttgtgaattaccctgcaaagccggtgctttcttataaagataaagccgtatttggttgccatgaaacatacaaactggatggcccggaagaagtggagtgtaccaagacaggaaattggtcggccctgccgagctgtaaagcatcttgcaaactctctgttaagaaggccaccgtgttgtaccaagggcagagggtgaagatccaggaccagtttaagaatgggatgatgcatggtgacaaggttcacttctattgtaaaaataaggagaagaagtgcagctacaccgaggaggctcagtgcatagacggcaccatcgagatccccaaatgcttcaaggagcacagttctctggcgttctggaaaacggatgcatcagatgtgacaccgtgctgaagacattttcagaatcaaaattgaatgtctcatttgtatctctgcttgtctgaggaatcaactgaaatagcagaat

SEQ ID NO: 4421 - DNA, 1840 bp, Rattus norvegicus
  Genbank Accession No. X15734
cgagaaactacaggcaaactttcagctttgaagttgtcaccttggagaagtgaagtcgagaagtgtgacaccatgaatggacctgtggatggcttgtgtgaccattctctaagtgaagagggagccttcatgttcacatctgaatcggtaggagaagggcatccagataagatctgtgaccagattagtgatgcagtgctggatgcccatctcaagcaagaccccaatgccaaggtggcctgtgagacagtgtgcaagacagggatggtgctcctgtgtggagagatcacctcaatggccatgattgactaccagcgggtggtgagagacaccattaagcacattggctacgatgactctgccaagggcttcgacttcaagacctgcaatgtgctcgtggctctggagcaacagtccccagacattgcccaatgtgtccatctagacagaaatgaggaggacgttggtgcaggagatcagggtctgatgttcggctatgccactgacgagacagaggagtgcatgccgctcaccattgttcttgctcacaaactcaacacccggatggcagatctgaggcgctctggtgtccttccctggctgagacctgattctaagactcaggtaacagttcagtacgtgcaggataatggtgctgtcatccctgttcgcgtccacaccatcgtcatctctgtgcaacacaacgaagacataacactggaggccatgcgagaggccctgaaggagcaggtgatcaaagctgtggtgccagccaagtacctggatgaagacaccatctaccacctgcagccaagtgggcggtttgtcatcggaggtccccagggggatgcaggtgtcacaggccgcaagattattgtggacacatacggaggctggggtgcccatggtggtggtgccttctctggaaaggactacaccaaggtggaccgctcagcagcttatgccgcccgctgggtggccaagtctctggtgaaggctgggctctgccggagagtccttgttcaggtgtcctatgccattggtgtggcagaacctctgtccatttccattttcacctacggaacttccaagaagaccgagcgagacgagctactagaggttgtgaacaagaactttgacctccggccgggtgttattgtcagggacttggatctgaagaagcccatctaccagaagactgcatgctatggtcatttcggaagaagcgagtttccctgggaggtccccaagaagcttgtgttttagagctgccgggaagcttagctctgtcctatactcaacctcctcaagatctcaactccctggtctcagagagccctccctgcttcccaccctatgcaaagccagcttcctccgattttccccctacccggcaatctgcaaacatcttaatagtggcaaggcaggtggtttctggtgctaggtcatcaggtctccttgcaaggatagtcagtgttccctccctgtctctcagatgacaacaatgttaattttgtgtaaaagttgctcctgtcatcccctcccgtagtctgaagctaaccaggccatctcttcctccgtcctggacatgtgcccagatgaatgttttgtcccatatctctggcttcccctttacattggcagccagaggtcctgagccggggcttcctcagggtccctctgagactgggcatctgctccctaggatatggtcagtgtcccctgaacatctgcattctgtgagggactgagctgtgtgttcttcatcccaacacaataaggtggtatcgtcattatccacagtgacagatggggaaactgaggctcagagagcgagctc

SEQ ID NO: 4422 - DNA, 817 bp, Rattus norvegicus
  Genbank Accession No. X51536
agcggcgccgggcagaagatggcggtgcagatttccaagaagaggaagtttgtagctgatggcatcttcaaagctgaactgaatgagtttctcactcgggagctggctgaagatggctactctggagttgaagtccgagttacgccgaccagaacagaaatcattattttagccaccagaacacagaatgttcttggggagaagggtcgtcggatcagagagctgactgcagttgtccagaagcggtttggcttccctgaaggcagcgtagagctgtatgcagaaaaagtggccacaagaggtctgtgtgccattgcccaggcagagtctctacgctacaaactcttaggagggcttgcagttcgaagggcctgctatggtgtgcttcggttcattatggaaagtggggccaagggctgtgaggttgtggtctctgggaagctccgaggacagagggccaagtccatgaagtttgtggatggtctgatgattcacagcggagaccctgttaactactatgttgacactgctgtgcgccatgtgctcctcagacagggcgtgctgggcatcaaagtgaagatcatgctgccctgggacccaagtggtaagattggtcccaagaagcctctgcctgatcatgtgagcattgtggaacctaaagatgaaatcttgcccaccacccccatctcagaacagaagggtgggaagccagagccacccgccatgcctcagccagtgcctacagcataacagggtcttggcagctgcatctggaggctggatgttgtcttgtaaagacgtttaataaaatcttgaa

SEQ ID NO: 4423 - DNA, 2376 bp, Rattus norvegicus
  Genbank Accession No. X51615
cgcggccgtccgctctcccaactcgcagccagtcggcgcgtcccgcctactgagcgcagcctccaccaggatccgcggggaccagctcgggatcagccggcgacccacttctgaccaacccaggagcggcccgatacccactcccgaccaacccgcgaccgacccagggacccactccggacctgctccttacaggggacagcgcctcgccgcttcccgccgcccagcgcccgcacgctcctcgggacacagtgccaaccatccagaggacaagatggattggggcacactacagagcatcctcgggggtgtcaacaagcactccaccagcattgggaaaatctggctcactgtcctcttcatcttccgcatcatgatcctcgtggtggccgcgaaggaggtgtggggagatgagcaagccgattttgtttgcaacactctccagcctggctgtaagaatgtgtgctacgaccactacttccccatctctcacatccggctctgggctctgcagctgatcatggtgtccacgccggccctcctggtagctatgcacgtggcctaccggagacacgaaaagaaacggaagttcatgaagggagagataaagaacgagtttaaggacatcgaagagatcaaaacccagaaggtccgtatcgaagggtccctgtggtggacctacaccaccagcatcttcttccgggtcatcttcgaagctgtcttcatgtatgtcttttacatcatgtacaatggcttcttcatgcagcgtctggtgaagtgtaacgcctggccttgtcccaatacagtggactgcttcatttccaggcccacagaaaagactgtcttcacggtgttcatgatctctgtgtctggaatttgcatcctgctaaacatcacagagctgtgctatctgttcattaggtattgctcagggaagtccaaaagaccagtctaatgcattgcctggctgttaagcaaagatgagggagaggatgaggcaacctgtgcttagttatcagagttcagctaccagcatctcccgggcaaacattcccaccttaaatgccgccatttgaagtcccccgcaggcctcccatgaaactccagaagcctccatgggcctcccttcccccaaagctcccaaacaaaggcccaattctatgcctgtattaatgggttctaaagttagttagaccccgtgctggtgtgactatgctttaggatacattcacagtttaaacaaagggatctcacattgtttctcttcctctgaggacaggagacatgagcccagtcctgaggaaggtacagagaaagttccttcttccgggtccccttccccaagttgcccccagttaagggtaaagaatcttcgttctgttattttctttcatagtttaagtttgcaacaatggacaaaagctatttaatgttcaagctagctgtgtccttttttttttttttaaatgaaaaccttaaaatgataggttcttttgttcttaaaatgatctggaaagcattatacattcctcctatttcagaggttcggtttgtgatgtgagcatggtgtataaccagatctcacaaggtctttaaaacgttggccttttggttatgggaaacctgggctgtggctgagagcccacctactgtattcatccttaggtgtgctgagtacagcccgcaacaacgttacagcctgtctcaaatgagacaaactggaagcttctcgtgttagcttctgacaagaagaggccttgattaaaattttcaaccgtaattttgtgtaagaggcagataggttatgcctacaactgccccctgccatgagcctaactcagcccccctccacccccagctcgtctactctgtagctgtgggatgtggcagtcagtatcaaaagacttcatgagtttgcttgggaatttcactgccatggtacaatttaatggtgcagaaacaagatggggtggttttcaaagaaccgatgaaacttctagactctaaatcctgttgattaaaactgagtttttctactttgaatgtctgtttgcctcccttttcagcattgccttctaaactggaaacagaaatgttgatatttggaaaaaatagaagaaactagtttaggtcaatgtgtaacttttctaggacaagttgaaccttagcattgtcattctgcctgatgtgttgtccacaagatgacagtcaacaaatccaacaggggacacttcttcctgccaagaatgtcgttgggaagccattctgtaacaataaataagagttgtggtttaaagtctacactattttacctaatgaagaacttattgctgatgttcagaaattcgacattgaaaggtgttttgccaatacggg

SEQ ID NO: 4424 - DNA, 509 bp, Rattus norvegicus
  Genbank Accession No. X51707
cctttcccctggctggcagcgcggaggccgcacgatgcctggagttactgtaaaagacgttaaccagcaggagttcgtcagagctctggcagccttcctcaaaaagtctgggaagctgaaagtccccgaatgggtggacacagtcaagttggccaaacataaagagcttgccccatatgatgagaactggttctacacacgagctgcttccacagcacggcacctgtacctccgtggtggtgcaggggttggttccatgaccaagatctacggaggacggcagagaaacggtgtcaggcccagccacttcagcagaggctctaagagtgtggcccgccgggtcctccaagccctggaggggctgaaaatggtggaaaaggaccaagatgggggccgcaagctaacacctcagggacagagagatctggacaggatcgccggacaggtggcagctgccaacaagaagcattagaacaaaggatgctgggttaataaattgcctcattcat

SEQ ID NO: 4425 - DNA, 2941 bp, Rattus norvegicus
  Genbank Accession No. X52583
cattctgatatattcccattcaacatggatatgtgtctatggtactatgtgggctatccaactttgcatcttggtctcattgtcccacaccagtgtggggggaattgccctgggaagatgatgcaatgttccctgtcatcatcatcgccatataagctttgtatatggatgtacctggatgactctgcctggagcgggcgtaagtcaaaactttgagagtctagtgcttttgcatgggatggactgtggctgctcttggcttatggagtgcttggtctcttttccccttgtccctcccaaccactactggtttccacctagagaaaaccccaagtaacatctgattagctgacctgggtctccacttatccctaagcactgggctctcatacccacccttgtgtcctggttccaactcactagagtgccttcttgtgaactgcctcagacttccaccttggtagtgggacgtgcgcctgcccaggagcactcaactcccattggtttactggagttggtcatgttagcaaaggaaagagcaggggtgctgccagctctgcatccagcccactaccctccacaccactgagcttgcctgtcccaaactgccatctgaccatgtcacttcctctgctctagacatcttcccaaggttgcagacgctgacggatttgccccagagtcgaagtaactgccacctggaaattccacagccatgagtgggtttaactttggaggcaccggggctcctgctggcggctttacatttgggaccgcaaagactgcgaccaccacacccgccactggcttttccttctctgcttctggcaccggcaccggagggtttaattttgggactccctcccagccagctgcgaccaccccttccaccagcctcttctcacttgccacacagacctcaaccacacagaccccaggattcaactttggaacaacacctgcttctgggggaacaggcttctccctggggatcagcaccccaaagctcagcctaagtagcacagccgccacaccagccacagccaacactggcagctttgggcttggcagcagtactcttaccaatgccatctcaggtgccagcacctccagccaggggacagcccccactggctttgtctttggctcttctaccacctctgctccgtccaccggcaccacgggattctcattcaccagtggcagtgcatcccagcctggagcctccggcttcaacattggctctgtgggtagtttggcccagcccacagcactgtctggctctcccttcactccagccactctggcgacaactacggcaggagcaacacagccagctgctgctacacccactgctgccaccaccagtgcagggtctacactgtttgcttcaatagctgctgctcctgcctcatccagtactacagtgctttccctctcagctccagcgacaactgcagccactcctactgctgggactttgggcttcagcctcaaggcccctggagcagctcctggtgcctccaccaccagcaccaccactactactaccaccaccactactactgcctccacctcctcctccaccacgaccactggctttgccttaagcctgaaacccctggtgccagctggccccagcagcgtggcagctactgctctgcctgcctccagcacagcagttgggactacgacgggtccagcaatgacctacgcgcagctggaaagcctgatcaacaagtggagtctggagctggaggaccaggagcggcacttcctgcagcaggccacgcaggtcaatgcctgggaccgcacactgattgagaatggggagaagatcaccagcctgcaccgagaggtggaaaaggtgaagctggatcagaagcgtctggaccaggagctggactttatcctgtcacagcagaaggagctggaagaccttctgagcccgttagaggagtcagtgaaggagcaaagtggcaccatctaccttcagcatgctgatgaggagcgtgagaagacctacaagctggctgagaacatcgatgctcagctcaagcgcatggcccaggacctcaaggacattattgagcacctgaacatggctggtggccctgcagacaccagtgacccactgcagcagatctgcaagatcctcaatgcacacatggactcccttcagtgggtggaccagagctctgccctgctgcagaggagggtggaggaggccagccgtgtgtgtgagagccggcgcaaggaacaggaacgcagcctgcgcattgcctttgactagccatacatgagttgggggtgggggtacctcttttgttgtagggctgctggctttggggtggttgtattgttgagaaaaatgctctttggtttggttccctgttatcagaagtggtttgcgaaggcatgatgtcatggatgtaataacctgtgtgctctggagacaggtgtgaaggtcactgaactctaggccagcatttaaagaacaagggcaaactcatcctttagccactccaatacaactgtgacagtgggatggcatgctccagagatgttggccaagaaactcacctggaatggagacatggcttctgtgcttccctgcttctctaactcccatctaacccatgtcctccagagcctgtgctgcacaaagcagagtcaccaagggagactgagcttaacaccggtttgcactggctacccctctcacccctctcttgtgagcttctgtggcagggactgactgctgatagttctttgagaacagagtggctgcggatttgcttctgaatgtcccagtgtcaaaccttagattcatagatagtgttgaaggctggcagttatgtctggtctattttatttctccacactctactgtagcctctatggtccctgatcaaaacattgcttttctaaataaagaaaa

SEQ ID NO: 4426 - DNA, 1880 bp, Rattus norvegicus
  Genbank Accession No. X52815
gggggggggggctgccgatcgcaatggaagaagaaatcgccgccctcgtcattgacaatggctccggcatgtgcaaagctggctttgctggggacgacgcccccagggccgtgtttccttccatcgtcgggcgcccccgacaccagggtgtcatggtgggcatgggccagaaagactcgtacgtgggtgatgaggcccagagcaagaggggtattctgaccctgaagtaccctattgagcacggcattgtcaccaactgggacgacatggagaagatctggcaccacaccttctacaacgagctgcgtgtggcccctgaggagcacccggtgcttctgaccgaggcccccctgaaccccaaagctaacagagagaagatgacgcagataatgtttgaaaccttcaataccccagccatgtacgtggccattcaggcggtgctctccttgtatgcatctgggcgtaccactggcattgtcatggactctggtgacggggtcacacacacagtgcccatctatgagggctacgcccttccccacgccatcttgcgtctggacctggctggccgggacctgacagactacctcatgaagatcctgactgaaaggggctacagctttaccaccactgctgagagggaaattgttcgtgacataaaggagaagctgtgctatgttgccctggattttgagcaagaaatggctactgctgcatcatcttcctctttggagaagagttatgagctgcctgatgggcaggtgatcaccattggcaatgagcgcttccggtgtccagaggctctcttccagccttccttcctgggcatggagtcctgtggcatccacgagaccaccttcaactccatcatgaagtgtgatgtggacatccgcaaagacctgtatgccaacacagtgctgtctggtggtaccaccatgtatccaggcattgctgacaggatgcagaaggagatcacagccctggctcccagcacaatgaagattaagatcattgctcctcctgaacgcaagtactcagtctggattggcggctccatcctggcctcactgtccaccttccagcagatgtggatcagcaagcaggagtatgacgagtcaggcccctccattgtccaccgcaaatgcttctagatggactgagcaggtgccaggcatctgctgcatgagctgattctgaagtatcgatttgccctggcaaatgtacacacctcatgctagcctcatgaaactggaataagcctttgaaaagaaatttgtccttgaagcttgtatctgatatcagcactggatcgtagaacttgttgctgatttttgaccttgtattcaagttaactgttcccttggtatatgtttaataccctgtgcatatcttgatttagtccttagttcatgtggctcggtcacttggtggctggggagatctgtggaaaagtcagtcagtccccagcctagtggatctctgtgagcaccatgtagtgatctgtgcagggtattaaccaacagcagacttccaggatttcccgaggctggcaagggttcctgaactagttaccacttcttttcttgccagtctaacagggtgggaaagtccgagccttaggacccagtttctgttctggttttttccctcctgacctccatgggttgttacttgccttgagttgggaacgtttgcatcgacacctgtaaatgtattcatccttttaatttatgtaaggtttttgtactcaattctttaagaaatgacaaattttggttttctactgttcagtgagaacattaggccccagcaacacgtcattgtgtaaagagaaataaaagtgctgcagtaaaaaaaaaaaaaaaccccccccccccccc

SEQ ID NO: 4427 - DNA, 936 bp, Rattus norvegicus
  Genbank Accession No. X53052
gaacttcggtctgcctccttttggagggccatatttgctgagttctttgctaccctcttctatgtcttctttgggctgggatcctcactgcgttgggcccctggacccctacatgtcctgcaagtggctttggcctttggcctggccctggccacactggtgcagactgtgggtcacatcagtggagcccatgtcaaccctgcggtcacttttgccttccttgtgggctcccagatgtccttgctccgtgctttctgctatatagcagcccagcttctgggagctgtggctggagcggctgtgctgtacagtgtcaccccaccagctgtccgaggaaacctagcactcaacacgctgcatgctggggtaagcgtgggccaggccaccactgtggagatcttcctgacgctccagttcgtgctctgcatctttgctacgtatgacgagaggcggaatggccgcatgggctctgtggccctggctgttggcttctccctcaccctggggcacctctttgggatgtattacactggcgcggggatgaatcccgcccgctcctttgctcctgctatcctcaccagaaacttcagcaaccactgggtgtactgggtgggcccaatcatcggcgggggcctgggtagcctgctctacgactttctcctcttcccacggctcaagagtgtttctgagagactgtctatcctcaagggagccagacccagtgactccaatggacagccagagggtacaggggaacctgtggaactgaagactcaggccctgtaaaagctgcagaacgccgctgggtttcagggaggcgcaagccagcccttggatgaagaaagagactgtggggagggggatcaatcggtacttctttattttttaacttacgtttttcattttttccttttgctgtgtgaaatctttcaagtt

SEQ ID NO: 4428 - DNA, 1197 bp, Rattus norvegicus
  Genbank Accession No. X53054
ctccttttctccagcatggtgtggctcgccagagattcctgtgtggcagctgtgatcctgctgctgacagtgctgagccctcccgtggcgttggtcagagaccccacgccacgatttttggaacaagttaaaggtgagtgtcatttctacaacgggacgcagcgagtccggtttctggccagatacatctacaaccgggaggagtacacgcgcttcgacagcgacgtgggcgagttccgcgcggtgaccgagctggggcggccctcagccgagtactataacaaacagaaggagtacatggagcagttgcgggccacggtggacacggcctgcaaacacgactacgagatctctgagagcttccttgttccgcggacagttgagcccaaggtgactgtgtacccttcaaagacgcagcccctggaacaccacaacctcctggtctgctctgtgagtgacttctaccctggcagcgttgaagtcagatggttccggaatggcgaggaggaaaaggatggactcgtgtccaccggcctgatccgaaatggagactggaccttccagttgctggtgatgctggagacggttcctcaaggtggagaggtttatacctgccaggtggagcatccaagcctgcccagccctgtcagagtggagtggaaagcacagtccacatctgcacaaaataagaagatgagtggagtcgggggcatcgtgctgggtctgctcttccttggagctgggctgtttgtctacttcaggaaccagaaaggacagtctggacttcagccaacaggactcctgaactgaggtgaggcgacaaggctgaaggaaggcgttctcccagtgtcaccatgtcttgaaacatgtcctgcttggcccacattcctccagagacagtgctctcccggacctggctcctcctgattctccaccccggagatctgtgctcctggtggctgtttagcccctggccaaaccttgcagccccggggacagaagccccctctctcaccactcctgctcccttttgtcccttgccctttgcctggcgcttctgagtcagtctgctgtcatatgctttctgacatctttctcaaataaacaaagaatgaaagtcatctacttcagagtttcaagcagaagaaataccattcatgcatagtaagcatgggggatagtgtataagaaataaat

SEQ ID NO: 4429 - DNA, 535 bp, Rattus norvegicus
  Genbank Accession No. X53378
ctctttgcttccagacctccgccatcatgggtcgcatgcacgctcccgggaagggcctgtcccagtcggcgctgccctaccgccgtagcgtgcccacgtggctgaagttgacgtctgacgacgtgaaggaacaaatttacaagttggccaagaaaggcctgactccttcccagataggtgtgattctgagggactcacatggtgtggcacaggtccgttttgtgaccggaaataaaatcttgagaatccttaagtccaaaggccttgcccctgatcttcctgaggatctctaccatttgatcaagaaagcagttgctgtcagaaagcaccttgagaggaacagaaaagataaggatgctaaattccgcctgattctaattgagagcagaattcaccggctggctcgatactataagactaagcgggtgctcccacccaactggaaatatgagtcatccacagcctctgctctggtggcataaatgctgttgcgtacacaagcaataaaatcactttgagtaaaaaaaaaaaaaaa

SEQ ID NO: 4430 - DNA, 664 bp, Rattus norvegicus
  Genbank Accession No. X53504
ctttcggttcggaggaggcaacggtgcaactttcttcggtcgtcccgaatccgggttcatccgacaccagccacctccaccatgccgcccaagttcgaccccaacgagatcaaagtcgtgtacttgaggtgcaccggaggcgaggtcggcgccacatccgccttggcccctaagatcggtcctctgggtctgtctcccaaaaaagttggtgatgacatcgccaaggctaccggtgactggaaaggcctcaggattacagtgaaactgaccatccagaacagacaggcccagattgaggtggtgccctctgcctctgccctgatcatcaaagccctcaaggagccaccaagagacaggaagaagcagaaaaacattaaacacaatggaaacatcacttttgatgagattgtcaacattgcccggcagatgagacaccggtctttggccagagaactttctggaactatcaaggagatcctgggtactgcacagtctgtgggctgcaatgtggacggccgccaccctcatgacatcatagatgacatcaacagtggtgcggtggagtgcccagctagttaagaagcaacgagaaggggttgggaatttagctcagtggtagagcgcttgccaagcccaaggccctgggttcagtccccagctccgg

SEQ ID NO: 4431 - DNA, 2497 bp, Rattus norvegicus
  Genbank Accession No. X54250
gaattcagcaataaagatgactctgaaattaacagtgagcaagataaagaaaattccttaatcaaaaatgaaccaagaagaattaaaatatttgatggagggtacaagtcaaatgaggactatgtatatgtccgaggcaggggcagaggaaagtacatttgtgaagaatgtggaatccgttgtaagaaacccagtatgttaaagaagcacatccgaacccacactgatgttcgcccctaccattgcacttactgcaacttctccttcaagaccaaaggaaatctgacaaaacacatgaagtccaaggcacatagcaagaagtgtgtggatttaggcatctcagtgggcttgatagatgagcaggacacagaagaatcagacgaaaagcaaagattcggttgcgagcggtctggctttgatcttgaagaatctgatggcccagatgaggatgataatgacaacgaagaggatgatgacgatagccaggcagagtccggcctctcagcagcaccgtcagtcacagcgagcccacagcatctcccatccagaagcggccttcaggatcctgggagtgtagaggaggaccttagagtttccagctgcttctcaggggtacacactgacccaatggacattctgcctagagcattactcaccaagatgactgttctgagcacggtgcagattgaccctaacaggacagacttaacagcaaaggccaggcagaatactgggaaagatgagcttgaactggctcctcctgtagacactcccatctccccagaagttacccccaggtctcccggccatcagatgtctgtgcattactctgaatctgatgctctgagaagccctgcagctggaaacactgttgcttcaatacaggattcaccatctgtgggactgcctcctgctactatagcccagctcaaccctcagccagcagccaggatttcttcctcagtctcacctcaccctgagagtcaagaaccgaagcagcaaataaccttgcaaccgtctccaggcttgccttcccctcagacacatttgttcagccatctccccttgcattcccagcagcaatcaaggaccccatacaacatggttcccgtagggggtatccatgtggtgccggccggtctcacctactccacttttgtacccattcaggccgggccaatgcaactgaccatccctgctgtgagcgttattcacagaaccgtgggcacccctgtggataccatcactgaagtttctggcgctactaatcgccctaccggagtggctgaattgagcagtgttgtgccatgtattcccatcggccaaatccacgtgccaggcctgcagaacctaagtcccccagccttgcagtcgctctcgtccctgggaatggaaacagtcaatatcgtgggcctggccaacgctaccgtgggtccgcaggtgcaccccccaggcctggccctcaacgcagtagggctccaggttctggccaacgctcctgcacagagcagtcccgccacacagacacacattccgggtctccaaatcctcaacatcgccttgcccaccctgatcccctctgttggccccgtggctgtgggcaccgcggggactccagaaactgccacttccaacagcaaaacagtggagccgcagacgcccgcaggccagggacacagtgccgagcctccacagaggttgcccgaaggccctcaggaaaccccacaaacagtgcccggtccctcagttgaccatgcaaggcctgacggctcaagcaaaatggacaccaagaaggtggcttctgcgagtcacgtgttgcctgggcgttcctctgcgcaggcgcagccggcacccataccggaagctttacagaagattgtagcttcaggcccaacatcacttcccacagacagaccggctcccaggcccccagtgccccacaggcagcccattgtgcacttcagcgacgtgagcagcgatgatgatgaggacagacttgtcatagcaacctagtggtttgttttttattgatttttttaatagcaggtttttttgaaaaaccctcctttccttaaagcacattttttctgacgtaaactcatgactaatctttgtgcaatcatgaacttttgaccaataattgtttttttgtgttagctccagccatttttgtacatgttgtatagacaattgtgccttttaggagttttatgtttagaatctgtacagatggttgaatatctatatacatacaatatgttatatatgtatatgaaaaccaggtagttgtgtttagtagaaacttgtcaaataaatcagatgattaaatgatatgttgcactgttaaatataaatttttatggctgtggggcagtttctgtgtataaattagtatgtaaacctcatatttattgtattcatattagtctttgcaaatggatctgtcattgtgtaagacagtaactgtatacttcaggcagattttctgtgggaattc

SEQ ID NO: 4432 - DNA, 1945 bp, Rattus norvegicus
  Genbank Accession No. X54419
gtatacatttgaatacacctttttcttcactttattggggattaagttcaacacatattaaagcagagtgtggggtagggagtaatgaaaaagaagatgtcaggaaaaggccatcatactcccaagagtgtgagtgtggtgagtgtgggcatctctagggagaccggtcatacatgcacatctttcaaagagaaattcaatgccctaaatggagtgtaaaggtggatcaaagttttagaaacattttttttctgttatagaaaatgctttttaaacaagaattgggggggtagagatgtttactattatgaaaagagaaaaaaaatgcatctttgaagacccaaggcactggaaacactgagtttcactacttgcctttattaggtgtcctctatctgattgttagaaattattcatttcctcaaagagagagaataaattgcttggggattcggccctgctctgcgctcttcctttgctaaaggcaaacgctgaaggcttcagaatcatgaggatgcttctgtgcttgaacgttctaactctcagctgtgtctgggccattgctatggagatccccatgagcacagtggtgaaagagaccttgatacagctgtccactcaccgagctctgttgacgagcaatgagacgatgaggcttcctgttcctactcataaaaatcaccagctatgcattggagaaatctttcaggggctagacatactgaagaatcaaactgtccgagggggcactgtggaaatactattccaaaacttgtcattaataaagaaatacattgacggacaaaaagagaagtgtggcgaagagaggcggaagaccaggcatttcctggattacctgcaagagttccttggcgtgatgagtacagagtgggcaatggaagtctgagactgagctggacaggatttcaccttttaagttaaattttcaacagatgcaaaaaaaaaaaaacccaaaaacaaaaaaaaacaaaaccccaaactgtacaaatgcaagggttatcgtatgctgtttccattcatatttatgccctgtagtcaagttaaacctatctatgtccagatatgccaaagtgtttaacattctttttgtgtctgtataacagaaatttagcccaggctggcctcaaacttataatgtagcagagggtgaccttgaactcccgatcctcctgagggctgagattacagacatgcaccattgtgactagttcatatggtgctgggcatggaacccagggctttgtgcacgctaccgactgagctgtactccctagacctcgtccccttctttgcatcagggtctcaagtattccaggctgactttgaactcagtgtgtatccaaggatgactttgaactcttggtccaggtggatgcagaaggatcacatacccaacttgagcatcctttctcctagcccttttagatagacggtactcaatggctctcttgctgggggatgccacaccaggcttcctgctcctatctaacttcaatgtaatacccactaatcaatctttcctcaactctctgctactctctccagcctccagtaatcccacttctatttctacagggttgacttttcttatgttctatgtatgaatcagattatgccatgattgtctctctgtgcctggagcagcccaattttggagaaaaaaaaggggggggggacatctccttgcagtgagagtgagagccagccacaggctgagccttacttttcagtgtaactaaacttaagaagcaaagtaaatactgcaacctttctaccccacatagacagaaagcatcaaatgggaggttattcaggtatcggggtcgctggagaagccttctgcagtttactccaggaaaacggatgtatgcttttatttaattctgtaagatgttcatattatttatgacatgtttaagaattc

SEQ ID NO: 4433 - DNA, 2812 bp, Rattus norvegicus
  Genbank Accession No. X55153
gggatggatccctggatggggccgtctctggatgacctttttctcattctctgctccaaacgttgtctctgtatttccttctgtgaatattttgcagaaccacaatttgaactcctagctaccgacccagcccacgtgcaagacgaaaagggtagaagggagggatcttccggtattaaggtgttaacagtgatgcatcttgggacttgtagttcgcctcaatacgacctgggcggggctccgattgcacgttgggagctgtggagccgtgtggcatgctgggaacgtgaggcgaaaaaggggattgaaaattttcgcccgtgtccccatggatttcgggagactctcgcctatgttacaggagcacttggcacttgaaaaaactcttgtttttgttgtgggaaacacatgaccggggacaaggcaaatttcttgcttccggcgcacccttatcgtcaataggaggcgcccctccgcggcttgttcccggagacttctgggtagcggtttacccccgcccactgcgtcagcatcttcctttcgccgccggacgccgccgaggtcgcacgcgtgaggtctgtccaccgcaaccgagtgagtaccctggccggctggggcgcagatagtggttgggactgagggatggaccgcggccgggagccgagggttgcatattttccgtgatcggaggcctggtgcctcacatggtctcacttgctggttaacaaggagtgggaagcagaaggcctctagggaaacctcaccaccgtaccttccttctctctgtcccattcagcatgcgctacgttgcctcttatctgctggccgccctcgggggcaactccaatcccagcgccaaagacatcaagaaaatactagacagcgtgggcatcgaggcggacgatgaacgactcaacaaggtagcttgctgctcactaggacccactggatccaaatgtctactagtagcggtccttaaatgttaggtccggattttacccttagagaaaatgtataggacctgttgaaaagggtggaaggaggaggcctacacccgtcttagtcatagttttctctttaatccttttgaggaccttgtgcaagtcaaagaaaatccgggcatgacaaaagtcctgctcatcgtgcttttgtagaagtttaatactactcgcttgtgggacttttgagatcaggtttactgtgtagctctgactaacctggaacgcactgtgtaaactagtttccttaactttttcctttttgaaactaacttggcagtaaaggatttacgcccacaagtgagaaacatctggtctccctggatctatagttagggttagctgataaatgtaagtgctgggagtcaaactcttaagatatggtgagtccgagctgtacagtgtgatcttacctggaaaagaacaggtcttcacagaatcttagaattttagtacctaaaacttgccactgccaacatctttgttgagaagacccagtactgtctcacggctagttactggggtagggtacaagtaggacaccttcccgtgtctgtctgtcttgcattactgactgctggttgtggttgtctattccaggtcatcagtgagctgaatggaaagaatattgaggatgtcatcgctcagggtgagttcctgggaagtgaacatgtttgtggtccatcctaatccctgctggtcagcccgtgatctgccaggcttcgcttgtggaccagagcatcctagaaaccctgccagagttgtgcgaggcctttttgtgtgcttgtgccggcagcgcttctgaacacgctggagctggcaatggggtcatttgttgattgctcctaccaggatgtgaaagccttttctgtgagcagggactgggggcactaaaaaattggtgcaggctctttcttaacttttattaggcatacagatttctggtaccaccagactacatcttatttgcaatctgaacagttaactgcacacgagaagcaaaaccagctcagcaactgacctagttagtctgtgaacctcaccccaaaagagctttgggcattgggtcacgctcatggtaaacacgttctcttgatttttagttaactaaaagtttgtgggttttccttttttttatttttttaagattttatataagtacactgtctccatcttcagacacacgagaagagggcatcagatctcatcatagatggttgtaagccaccatatggttgctgggaattgaactcaggacctctggaagagcagtcagtgctcttaaccactgagtcatctctccagcccggaaaacaagtcttaaacagtattaatggtgttcctaagtgtgtgcaaagttgcattgtgttttagagtgaaagcaggtggcagtggtgttccttgtgttggtgagtctacccttacagaacagcctttctggctgggtctctgttctgtctggtctcatgttctttctattttaacataggtgttggcaagctggccagtgtgcctgctggtggggctgtggctgtttctgctgcccctggctctgcagctcctgctgctggttctgcccccgctgcaggtaaatagaggtctgatgagtgggtggtgatcaaagggggggttggtgctcagagtttattttattgttggccggggctcctgggaaaatctggatgcttactatggtgttcctccacagcagaggagaagaaagatgagaagaaagaggagtctgaggagtcggatgacgacatgggatttggcctgtttgattaagatcccctgccaataaagcctttttatgt

SEQ ID NO: 4434 - DNA, 2674 bp, Rattus norvegicus
  Genbank Accession No. X57523
  misc_feature (1)..(2674): n = a or c or g or t
cgcggagagttccaggctgggaccggactctggacagcgcacgctcgatggctgcgcacgcctggccgacggccgccttgctgctgctgctggtggactggctgctgctgcggcccgtgctcccgggaatcttctccctgttggttcccgaggtgccactgctccgggtctgggccgtgggcctgagtcgctgggctatcctgggactaggggtccgcggggtcctcggggtcaccgcgggagcccgtggctggctggctgctttgcagccgctggtggcggcgctgggtttggccctgcctggacttgcctcgttccgaaagctgtccgcctggggagcactccgggagggtgacaacgctggactgctccactggaacagtcgcttagatgccttcgttctcagttatgtggccgcattgcccgcagctgccctgtggcacaagttggggggcttctgggcgcccagtggccacaagggcgctggagacatgctgtgtcggatgctaggcttcctggactccaagaaggggcgtctccacctggttctggttctcttgatcctctcctgccttggggaaatggccattcccttcttcacaggccgcatcactgactggatccttcaggataagacagcccccagcttcgcccgcaacatgtggctcatgtgtattcttaccatagccagtacagtgctggagtttgcaggagatggaatctacaacatcaccatgggccacatgcacagccgcgtgcatggagaggtgtttcgggccgtccttcaccaggagacaggatttttcctgaagaacccaacaggttccatcacatctcgggtgactgaggacacctccaacgtgtgcgagtccattagtgacaagctgaacctgttcctgtggtacctggggcgaggcctgtgtctcctggcgttcatgatttgggggtcattctacctcactgtggtcaccctgctcagcctgcctctgcttttccttctgcccaggaggctggggaaagtgtaccagtcactggcagtgaaggtgcaggagtctctagcaaagtccacgcaggtggccctcgaggccctgtcggcgatgcctaccgtacggagctttgccaacgaggagggagaggcccagaagtttaggcagaagttggaagaaatgaagccgctaaacaagaaagaggccttggcttacgtcactgaagtctggaccatgagtgtctcgggaatgctgctgaaggtgggaattctgtacctcggtgggcagctggtggtcagaggggctgtcagcagcggcaacctcgtctcctttgttctctaccagcttcagttcaccagggccgtggaggtcctgctctccatctatccctccatgcagaagtccgtgggcgcttcggagaaaatattcgaatacctggaccggactccctgctctccgctcagtggctcactggcacctttaaacatgaaaggcctcgtcaagttccaagatgtctcctttgcctacccaaaccatcccaacgtccaggtgcttcaggggctgacttttacgctgtatcccgggaaggtgaccgccttggtgggacccaatgggtcagggaagagcaccgtggccgccctgctgcagaacctgtaccagcccaccgggggcaaggtgctcctggatggcgagcccctggtccagtatgatcaccactacctgcacacgcaggtggccgcagtgggacaagagccactgctatttggaagaagttttcgggaaaatattgcctatggcctgacgcggactccaaccatggaggaaatcacagctgtggccatggagtccggagcccacgatttcatctctggattccctcagggctatgacacagaggtaggtgaaactgggaaccagctgtcaggaggtcagcgacaggcggtggccttggctcgagccttgatccggaagccacgcctgcttatcttggacgatgccaccagtgccctggatgctggcaaccagctacgggtccagcggctcctgtatgagagccccgagtgggcctctcggacggttcttctgatcacccagcagctcagcctggcagagcgggcccaccacatcctcttcctcaaagaaggctctgtctgcgagcagggcacccacctgcagctcatggagagaggagggtgttaccggtccatggtggaggctcttgcggctccttcagactgacgggcttctggactgcaagctgcgcgagtccctccccctgctgtcctctgctctgtgtggcggagaacctgggagcaaagattttaccacatccacggagatagttgaggagcgatggtgtttgttacatgaggaaaatgtaacctctaggagatgcccggaatttaccacnaatgttttcccgccccgccccctgttagacgggggatgggggtaggtaccccaggctaacactgagctgctgagtctcctgtctcccgtggagtttgcatcacggcatgcgcccacaaacctggcttatgtggcgttgggacagaatgagaagaaacgctcaaaatgtacagagaaggggcaaatagcttgcaattaaccaaaggcataggctggcctatgggtgttccgcgggttcttgatatttataataaaactggtgttttgtaaaaaaaaaa

SEQ ID NO: 4435 - DNA, 516 bp, Rattus norvegicus
  Genbank Accession No. X57529
cacaggaggcctacacgccgccgcttgtgccgccgccatgtccctagtgatccccgagaagtttcagcacatcctgcgagtactcaacaccaacatcgatgggcggcggaaaatagccttcgctatcactgccattaagggtgtggggcggagatacgctcatgtggtgttgaggaaagcagacattgacctcaccaagagggctggggagctcacggaggacgaggtggagcgtgtgatcaccatcatgcagaacccacgacaatacaagatccctgactggttcttgaacagacagaaggacgtgaaggatgggaagtatagccaggttctggccaacggtctagacaacaagctgcgtgaggacctggagcggctgaagaaaatccgagcccatagaggactgcgccacttttggggccttcgtgtccggggtcagcacaccaagaccactggccgcaggggccgtactgtgggtgtgtccaagaagaaatgagtctttgggcctttgctgtt

SEQ ID NO: 4436 - DNA, 2137 bp, Rattus norvegicus
  Genbank Accession No. X57986
gccgcgtcgcagctccgagactggccccggccgcgacgccgccgcgatgggcaacgccgccgccgccaagaagggcagcgagcaggagagcgtgaaagagttcctagccaaagccaaggaagatttcctgaaaaaatgggaagacccctctcagaatacagcccagttggatcattttgatagaatcaagacccttggcaccggctcctttgggcgagtgatgctcgtgaagcacaaggaaagtgggaaccactatgccatgaagatcttggacaagcagaaggtggtgaagctgaagcagatcgagcacactctgaatgagaagcgcatcctgcaggctgtcaacttcccgttcctggtcaaacttgaattctccttcaaggacaactcaaacttgtacatggtcatggagtacgtgcctggtggggagatgttctcccacttacggcggattgggaggttcagtgagccccacgcccgtttctacgcggcgcagatcgtcttgacttttgagtatctgcactccctggacctcatctaccgggacctgaagcccgagaaccttctcatcgaccagcagggctatattcaggtgacagacttcggttttgccaagcgtgtgaaaggccgaacttggaccttgtgtgggacccccgagtacttggcccccgagattatcttgagcaaaggctacaacaaagctgtggactggtgggctctcggggtcctcatctacgagatggctgctggttacccgcccttcttcgctgaccagcctatccagatctatgagaaaatcgtctctgggaaggtgcggttcccatcccacttcagctctgacttgaaggacctgcttcggaaccttctgcaggtggatctcaccaagcgctttgggaatctcaagaacggggtcaatgacatcaagaaccacaagtggtttgccacaactgactggatcgccatctatcagagaaaggtggaagctcccttcataccaaagtttaaaggccctggggacacgagtaactttgacgactatgaggaggaagagatccgggtctccatcaatgagaaatgtggcaaggagtttactgagttttaggggtgtgcttgtgccccatgggttttcttttcttttttttttttctttttctttctatttttttttctggttgggggtgggggggttggatcgaacagccagagggccctagagttccatgcatctaatttaacatccactccacacccccagggttaaggagagcaggaaagtcagatactggggaaggggcaacatcagctgctccccctctcccttcacctccaccctgcccttcctgttttcaatgaatttcttagctccagtcatactcaatcttgctggtgtatccaggggcgagtagggaaagagggccccaaattcagcctccacccctaccccagcactggatactaaggatgaacagtaaagccaaccttcccttccatgcagccctacctggaaagggagattttatgacctatacagagggctgcttgccagtggggttttttttttttttttcctcatttaaattaagttccaccagtgcctcccaccctccaaattgtcccacccctctcaaccccacccccactccctaaatccattctgatgagacccgggtagccaactgactctgtcaaggaaggaactgggcttggaacctcgccctgagctgctagcctcccggcccccctttccagtggtctcatgccaattgttctgtgcaccagcccccctaagaagcccctccccatcctgggcgctcacttctagcttagctgtcagctgtccatcacctcttgccgtgtgtccccactcactgcacccccaagtctgattgtgctttttctctcaatagaaaggtggggagctgctggggatatgaccccgtttatccctgtgtttatccctctcgtaacttctcccaaaaaggaggagctctcaggcctgggtgggggccccgggtgggcgagaggggccgttcaacctgtgtgcttcgaaggatgagacttcctcttgaacagtgtgctgttgtaaacatatttgaaaactattaccaataaagttttgttttaaaaaaaaaaaaaa

SEQ ID NO: 4437 - DNA, 499 bp, Rattus norvegicus
  Genbank Accession No. X58200
ctctttccggacgctcaagatgtcgaagcgaggacgtggtgggtcctccggagcgaaattccggatttccctgggtcttccggtaggagctgtgatcaactgtgctgacaacacaggagccaaaaacctgtatatcatctctgtgaagggaatcaagggacggctgaacagacttcctgctgctggtgtgggcgacatggtgatggccacagttaagaaaggcaaaccagaactaaggaaaaaggtacatcctgcagtggtgattcgacaacgaaagtcatatcgaagaaaagacggggtgttcctttattttgaagataatgcaggggtcatagtaaacaataaaggcgagatgaaaggttctgctatcacaggtccagttgcaaaggagtgtgcagacttgtggcccaggattgcatccaatgcaggaagcattgcctgattctccagtgtgtttgtaaaatatattcattaaagtcttctctctgaaaaaaaaaaa

SEQ ID NO: 4438 - DNA, 628 bp, Rattus norvegicus
  Genbank Accession No. X58389
cctgttagcggccagaggtaacctgtgaagatggttcgctactcccttgacccagaaaaccccacgaaatcatgcaagtcaagaggctcaaaccttcgtgttcactttaagaacacccgggaaactgcccaggccatcaagggtatgcatatccgcaaagccaccaagtatctgaaggatgtcactttaaagaagcagtgtgtgccattccggcggtataatggtggagtcggtaggtgcgcccaggccaaacagtggggctggacacagggacggtggccaaaaaagagtgctgaatttttgctgcacatgcttaaaaatgcagagagtaatgctgaacttaagggtttggatgtagactctctggtcattgaacacatccaggtgaacaaggctcctaagatgcgcagacgaacctacagagctcacggccggattaacccatacatgagctccccctgccacatcgagatgatcctcactgagaaggaacagattgttccaaagccagaagaggaggttgcacagaagaaaaagatatcccagaagaaattgaagaaacaaaagctcatggcacgggaataaattcagcataaataaatgcggataaagtaaaaaaaaaaaaaaa

SEQ ID NO: 4439 - DNA, 744 bp, Rattus norvegicus
  Genbank Accession No. X58465
ctcttcctgtctgtgccagaactgcgcgtggtccgcgccgatcgactgagaagcccggtttgcgctctcagaatgactgaatgggaaacagccacacccgcggtggcagagaccccggacatcaagctctttgggaaatggagcactgatgatgtgcagatcaacgatatttctctacaggattacattgctgtgaaggagaagtatgccaagtacctgccccacagtgcaggacggtatgctgccaacggtttccgcaaagcacagtgtcccatcgtggagcgccttactaactccatgatgatgcacggtcgtaacaacggcaagaagctcatgactgtacgaattgtcaagcatgcctttgagatcatccacctgctcactggtgagaaccctctgcaggtcctggtgaatgctatcatcaacagtggcccccgagaagactcaacacgcattgggcgggctggaacagtgagacggcaggctgtggatgtatccccacttcgccgagtgaatcaggccatctggctgctgtgcacgggggctcgtgaggctgctttccggaacatcaagaccatcgctgagtgccttgcagatgagctcattaatgctcgcaagggctcctccaactcctatgctatcaagaagaaagatgaactggagcgtgtggccaagtctaaccgctgatttcccagctgctgcctaataaattgtgtgccctttgggacagttacatcaaaaaaa

SEQ ID NO: 4440 - DNA, 1241 bp, Rattus norvegicus
  Genbank Accession No. X58830
gaattcgacatcacagcaactagcaatctgtgggtggtgacaccgcagcacaacatgggactccagctgagtgtggtgactcgggacggactccacatcaacccccgtgcggcgggcctggtgggcagagacggcccttacgacaagcagcccttcatggtggccttcttcaaggtgagcgaggtccacgtgcgcaccaccaggtcagcctccagtcggcgtcgacagcagagtcgcaatcggtccacccagtcgcaggacgtgtcccggggctccagtgcttcagactacaacagcagtgagttaaaaacagcttgcaagaagcatgagctttacgtgagcttccaggacctgggatggcaggactggatcatcgctcccaaaggctacgctgccaactattgtgacggagagtgttccttccctctcaatgcacacatgaatgccaccaaccacgccattgtacagaccttggtccaccttatgaatcccgagtacgtccccaaaccatgctgcgcaccaaccaaactgaatgccatctcggttctttacttcgacgacaactccaatgtcatcttgaaaaaatacaggaacatggttgtgagagcttgtggatgtcattgagtggaagccagttgcaggggctgtgattctgcctcggattcctaacatctgccttaaaacacgggaagcagcacagtgcagcgggagcatgacactcaaagcatctcctgctggtgccttagcccaaggaggattttacgaggaccttgtcgatggctttcccagttgagcagttgctggtctgtaggaagctgtaatgcttgtagcacaggcctggaaactacagaaacatagtgttctcctcccccagtcccacccagactagtcttagcttttagatctagctgtttgtggtgtaagtaggagataaacttgaaggaatattaaatatccctggttgaaagacagatctagtggttctacagcacccatcccagggagattttgcagatagccgaatggaggagaggagaacactctattagattccattcccagcaaagggcagctcccacagaacctgcagcctggccatcacagggctttgtggaggtgccttctgtctactgttagttacccgttttatgttgactcttggtggtgtgaaaatgtactaatttcggtcaaaacaaactatagcattcccacgccatactcctcccttactcacagaattc

SEQ ID NO: 4441 - DNA, 497 bp, Rattus norvegicus
  Genbank Accession No. X59375
aaagttgctgctaggcgctcgaaagcgagcacctcatctcagagatctggagcggccgcgcttgcggagctgtcaccatgcctctggctagagatctattacacccttccttggaagaggaaaagaaaaaacataagaagaaacggctggttcagagcccaaattcttacttcatggatgtgaaatgtccaggttgctacaagattactacagttttcagccatgctcagacagtggttctttgtgtgggttgttcaaccgtgctgtgccagcccacaggagggaaagccaggctcacagaaggctgttcatttagaagaaagcaacactaatcatctatacaagttcctgaattcgtgtttttcacagaaagccttatcaactttagttactctaccaagacaatgtaattattgtttgattttataaagtctacaacaatgatctcctattttggtgtcagtttttcaataaagttttacttatgaacaagttca

SEQ ID NO: 4442 - DNA, 1092 bp, Rattus norvegicus
  Genbank Accession No. X59608
tactcaccaacatcaccagcatatgagccgcgctcccctgggggctatacaccgcagagcccctcctactccccaacttctccttcctactccccaacgtctccgtcttattctccaaccagtcccaactatagtcctacctcacctagctactccccaacctctcctagctattccccaacctctccatcctactcaccaacctctccatcctactcaccaacctctcccagctactccccaacctctcccagctactccccaacatcacccagctattctccaacttctcccagctactcaccaacatctcctagctattccccaacatctcccagctactcaccaacctctccaagctattctcccacctcccccagttactcaccgacatctccaagctactcaccaacttctccaagttactcaccaacttccccaagttactcacccactagccctaactattccccaactagtcccaactataccccaacctcacccagctacagcccaacctcacccagctactcacctactagtccaaactatacacctaccagccctaactacagcccaacctctccaagctattccccaacctcacccagttactctcccacctcacccagctactctccctcgagcccacggtatacacctcagtctccaacctacacaccgagttcaccaagctacagccctagctcgccaagctacagccctacttcccccaagtataccccaactagtccttcctacagtcctagctcaccagagtataccccaacttctcccaaatactcacctacaagccccaaatattcacccacttctcccaagtattctcctaccagccccacttactcacccaccaccccaaaatactcgccaacctctcctacatattcaccaacctctccagtctacaccccgacctctcccaagtactcccctactagtcctacctactccccaacttctcccaagtactcgcccaccagtcccacctactcacccacctctcccaagggctccacctactctcccacttctcctggctactcccccaccagccccacctacagcctc

SEQ ID NO: 4443 - DNA, 2059 bp, Rattus norvegicus
  Genbank Accession No. X60659
gagcagaagcaacagcaggagaagcagcttctgaagacaaaaccttcaacaaggagcaaggtttcagccacaaagatgtgggttctccaggccttggccatcatgttgagcatccaagcaggagtacttgacctggtggaagtgccccccgtggtgcgcagtcttcctgttgctcttcctgctccggtcaatctccctgcagttctcccaggttctccaggcctcaatgatccagccaaaaatcgcatgctacctcccaaaaggcctggagctccttccagaggtggaaagtgtgcacctgcagccagatacttcctctccagtgacaaactccaggcctacctcctgagcatactgcccccacagattgaggacatggtgaagtgtgataaagttaacatggaaggcgtgcttggggatatcttagccacgatgcaggactctaacctgctctccatcttagatatcacttccctcctgcaagggggaggagggcttggccttggtggactcctaggcaaagaaggtaatgaggatccctcaaagccctcatcaggatccaaggccactggtggccttggccagctactcccagagggcctcccaggcaaggaaggcctgggcggcttactaaaccttggtggaggcaaaggctctggaaaaggactcctgaatggggatgggctctccaatgtcgtgaagcctctggatgacatagttgaaaatgtggacagtctgaaagctgctgttcaggacaaagtgaagagtgtggtcccagaaaacatcaaggatccattttcagatctgctcaacatggatatccaagaaactatgctcaaattaaaggtgaaacaagtaaaagtgggcagcaccgatataaacatgggagctgatgggatcaaagttctctccgaagttactgccgacgtagaaggagaaggcttgcttgggccagtcttcaccctattgcagtttcaatctgtcatggatgtaacaatgaacattgctgtttcctccaacaacacccagtgcgtcaaccttgatgtccaagacacccacatgcatgtcaaggaaatgaacatccagttactacagactgtcacagaaactgttcctctgcctacgtctctgcccttgaatgacatcatcccaatagtgctgacagcaaaaatgaatgaaaatctggaaaaatccgactcttgtggtatcgtcctcagtgacttcaatgactgcaagaacactactggcttattcggttaccaagttcacactgccaggatctctcccaaaggactttctatcgactactgcgttaaagccaatatagacaacaaaacagtacccgtgcctggaggtcggctgcctccagatcccaaaaacgccaacgtgtccataaccacttgcctcctcagcactgaggacacttgtgaaatacgtggccaaacagagctctgttcagatgaatgacctggaagcacaaatcacctatatagcctttgccccccaggaaaacaatatgctcagattgctgtataaggttgacataacaaaggacagccagccctatgccactggggaaacgaaattattcatctcccatgcctgcaagattttaaattctaaactggtaccagacgtcaaactcacaaggtctgagcacagtgtggtgccccctgagactaaggaagaagtagaaggcattatggctgaagtcacaaggaaggcctggtccagattcaatgagctgtataaaaagatgagtattccggacggagtgtcttcaaatactctaacgaactccgatgtcaaattgctgagatcaaatgaccttcaggcagcaagctgaagccagcactactgaacccaaagtactgaacgacagcaaaaccccctgcaaattcttcccatgccccttgcagcccatccttatgattcattaaacaatagcaatggtctcctggcatgcccaggtcctctgccttgagtgacaaggacaagaacagttggaggaaatgggcactgctgtaatcagctccttaataaacactcccttcatgca

SEQ ID NO: 4444 - DNA, 498 bp, Rattus norvegicus
  Genbank Accession No. X61381
tgtgtgcgatcgcggtggatcgctaccatgaaccacacttctcaagccttcgtgaacgctgccactgggggacaacccccaaactacgaaagaatcaaggaagaatatgaggtgtctgaactgggggctccccacggatcggcttctgtcagaactaccgtgatcaacatgcccagagaggtctctgtgcctgaccatgtggtctggtccctgttcaatacgctcttcatgaacttctgctgcctgggcttcattgcctatgcctactctgtgaagtctagggatcggaagatggtgggtgatatgactggagcccaggcctacgcatccactgccaaatgcctgaacatcagctccctggtcctcagcatcctcatggtcattatcactattgttactgtcgtcatcattgctcttaatgctcctcgtctccagacttgatagaggattctggtttctgatcctgacgtgcttcacgctctgctggctgcccttttt

SEQ ID NO: 4445 - DNA, 843 bp, Rattus norvegicus
  Genbank Accession No. X62145
ctcttttggccttgcttgccggcagactcgccgccatgggccgtgtgatccgaggccagaggaaaggtgccggttctgtgtttcgtgcgcacgtgaagcaccgtaagggagccgcgcgtctgcgtgctgtggacttcgcggagcgacacggctacattaaaggcatcgtaaaggacatcattcatgaccctggccgcggcgctcccctcgcgaaagtagtctttcgtgatccctatcgattcaagaagcggacagagctgttcattgccgcagagggaatccacactggacagtttgtgtactgcggcaagaaggcccagctgaatattggcaatgttttgcccgtgggcaccatgcctgagggtactatcgtgtgttgtctggaggagaagcctggggacaggggcaagctggcacgagcctccgggaactatgctacagtcatctcccacaacccagagaccaagaagacccgagtgaagctgccttcagggtccaagaaggtcatttcctctgctaaccgagctgttgttggtgtcgtggctggcgggggcagaattgacaagcctatcttaaaggctggccgtgcctaccataagtacaaggcaaagaggaactgctggccacgtgtgcggggtgttgccatgaatcctgtggagcatccctttggcggtggtaaccaccagcacattggcaagccttccactatccgaagagatgccccagctgggcgcaaagtgggtctcattgctgctcgccggactggacggctacgtggaaccaaaactgtacaggagaaggagaactagagttcaggagctaataaagtatgtgctttggcta

SEQ ID NO: 4446 - DNA, 585 bp, Rattus norvegicus
  Genbank Accession No. X62146
tcttcctgttctccaccatggcgcaagatcagggtgaaaaggagaaccccatgcgggaacttcgtatccgcaagctctgcctcaatatctgcgtgggggagagtggagacagactgacccgagcagccaaggtgttggagcagctcacaggccagacccctgtgttttccaaagctagatacaccgtcaggtcctttggcatccggcgaaatgagaaaatcgctgttcactgcactgtccgtggagccaaggcagaggagattctggagaaaggcctgaaggtgcgagagtacgaattacggaagaataacttctcagataccggcaactttggctttgggattcaggaacacattgacctaggcatcaaatatgacccaagcattggcatctatggcctggatttctatgtggtgctgggtaggccaggtttcagcatcgcagacaagaagcgcagaacaggctgcattggggccaaacacagaatcagcaaagaggaggcaatgcgctggttccagcagaagtatgatggcatcatccttcctggcaaataaactttatccaaaggccaataaagttttctca

SEQ ID NO: 4447 - DNA, 1316 bp, Rattus norvegicus
  Genbank Accession No. X62166
cgagacatatcggcggcgtgtggcggcgagatgtctcacaggaaattctcagctcctaggcatgggtccttgggcttcttgcctcggaagcgcagcagccggcatcgtggaaaagtgaagagcttccctaaggatgacccttccaagcctgttcacctcacagccttcctagggtacaaggctggcatgacccacattgtccgggaagttgaccggccaggatctaaggtgaataagaaagaagttgtggaggctgtgaccattgtggaaaccccacccatggtggttgtgggtattgtgggatatgtagaaaccccacgaggcctccggaccttcaagactgtatttgctgagcacatcagcgatgagtgtaaaaggcgtttctataagaattggcacaaatctaagaagaaggcttttaccaagtactgtaagaaatggcaagatgacacaggcaagaagcagctggagaaggacttcaacagcatgaagaagtactgccaggtcatccgcataattgctcacactcagatgcgcctgcttcctctgcgccagaagaaggcacacttgatggagatccaggtgaatgggggcactgtagctgagaagctagactgggcccgagagaggctggagcagcaggtccctgtgaaccaggtgtttgggcaagatgagatgattgacgtcatcggcgtgacaaagggcaaaggctacaaaggggtgaccagtcgttggcatacaaagaagctgccccgaaagacccacagaggtctgcgcaaagttgcttgtattggagcttggcatcctgcccgtgtagccttctctgtggctcgagctgggcagaaaggctaccatcaccgaacagagatcaacaagaagatttacaagattggtcaaggctacctcatcaaggatggtaagctgatcaagaacaatgcatctactgactacgacctgtctgacaagagcatcaacccactgggtggctttgtccattatggtgaggtgaccaatgacttcatcatgctcaaaggctgtgtggtgggaaccaagaagcgagtgcttactctccggaagtccttgctggtccagaccaagcgtcgggctcttgagaagattgacctgaagttcattgacaccacctccaaattcggacatggtcgcttccagaccatggaggaaaagaaagcattcatgggaccgctcaagaaagatcgcattgccaaggaggaaggtgcctgatgccaggagtactttgtgcagctggtggggtctcatcaataaaatattttcaattaaaaaaaaaaaaaaaaaaa

SEQ ID NO: 4448 - DNA, 466 bp, Rattus norvegicus
  Genbank Accession No. X62482
tgtggctgcagtggtccacactactctctgagtttcgccatgccgcccaaagacgacaagaagaagaaggatgccggaaagtcggccaaaaaagacaaggacccagtaaataaatctggtggcaaggccaaaaagaagaagtggtccaaaggcaaagttcgggacaagctgaacaatctcgtcctgtttgacaaagctacttacgacaaactttgtaaggaagttcccaactataagcttattactccagctgtggtctccgagagactgaagattcgaggttccttggccagggcagcccttcaggagctacttagtaaaggacttatcaagctggtttcaaagcacagagcccaagtaatttacaccagaaacacaaagggtggagatgccccagctgctggtgaagatgcataaacagattgaatcagctgtacatttgggaaaataaaactttattgaatca

SEQ ID NO: 4449 - DNA, 893 bp, Rattus norvegicus
  Genbank Accession No. X62660
ccaataaggaaactctgaaccaggagtcatggaagtcaaacccaagctctactactttcaaggcaggggaaggatggagtcgatccgctggctgctggctacagctggagtggagtttgaagaagaatttcttgagacgagagaacaatatgagaagttgcaaaaggatggatgcctgctttttggccaagtcccattggtggaaatagacgggatgctactgacacagaccagagccatcctcagctacctggccgccaagtacaacttgtatgggaaggacctgaaggagagagtcaggattgacatgtatgccgatggcacccaggacctgatgatgatgattatcggggctccatttaaagcccctcaggaaaaagaagagagcctagctttagcagtgaagagggctaaaaaccgttacttcccagtgtttgaaaagattttaaaagaccatggagaggcatttcttgttggcaaccaactcagttgggcagacatacagctactagaagccattttgatggtggaagaagtcagtgctcctgtgttgtctgacttccctctgctgcaggcatttaagacaagaatcagcaacattcctacaattaagaagttcctgcaacctggaagtcagaggaagccacctccggatggccactatgttgacgtggtcaggaccgtcctgaagttctagtgacagcgtgctttaaagtggctactgcaagggtccaatcacagcagcagctacagagcattccagaggcaagatagagctctcaggagtaaaggtcttcaaagaacctgaaaaccactctgtccaacaatgacaaatgccaattaaatagagtgaaaaactgttaaaaaaaaaaaaaaaaaaaaaaaaaaaaaaa

SEQ ID NO: 4450 - DNA, 522 bp, Rattus norvegicus
  Genbank Accession No. X62671
tctttcttgactccatcttcgcggttgcagcagcggcgtccgcgggtaagtagccaacatgcagctctttgtccgcgcccaggaactacacaccctcgaggtgaccggccaggagacggtcgcccagatcaaagctcatgtggcctcactggaaggcattgcccccgaagatcaagtcgtgcttctggcaggctcgccgctggaggatgaggccaccctaggccagtgtggtgtagaggccctgaccactctggaggtagctggccgcatgctgggaggtaaagttcatggttctctggctcgtgctgggaaagtgagaggtcagactcccaaggtggccaaacaggaaaagaagaagaagaagactggtcgggccaagaggcgaatgcagtacaaccgacgctttgtcaatgttgtgcccacctttggcaagaagaagggccccaatgctaattcctaagtcctgttgtgatcctgccacactaataaagccactttgcccagaaaaaaaaaaaaaaaaaa

SEQ ID NO: 4451 - DNA, 466 bp, Rattus norvegicus
  Genbank Accession No. X62950
aggaaagacagaatcctactagaggccagaaagaatgttccagacatgggtggaaggccctcactcccgactgacttcaatacgcctgaaggtagggagtgctccatgtctgcccccaggctccaagggtgggtctcctagggcctggaaaatgccccaccaatctggctaagataaggaaagggtatgaagagaaagttacagaaatttgaagggttaagctaagttgctgagagttagtataagttacagagaaagtaaggttaaacaaagagaaagagaaaagaaggtaaaaagagcaggaagctagggaagaaaagagactaaaagaagaggaagctagagagctaaagagagataaaagacaagagaggaacatatactggccacagtagttagggaacctaggaagacagtacctggcaacagaagagaattcctggctaaagatcagtgtgcctaatgc

SEQ ID NO: 4452 - DNA, 1303 bp, Rattus norvegicus
  Genbank Accession No. X62951
gtaacattacatatgttagtactcctaacacttcttgggactgtgcctcagggatcacaacctatataagtttagaagttctgaaagacagtcatgaccttggtatataggttcagatagtgtccagattggaatcctgatgctaaagacttagtaagagacaaaaaaaaggagttgagaattacttagggctagggctatctaggtgctacaagggcagcacaaggacatctgctgttgccctacaatacaaggcttatagagaattcagaactgccattgactcagatataaaaagagtaaaagactttttagctgacctccaagaatacctaacttccctctcagaggtagtccttcaaaataagaaaagattagacctgatattccttaaagaaggagtctgtgtgctatactgaaagaaaaatgttgcttctatacagaccattcaggagtaattaaagactccataaataaacttaaaaaaaggttagacaaaagacagacagacagaaaaacacatcagagatagttcgagagctagtttagtagatctccctggatgactaccctactctctgctacagctgggccattattaataattttcttggttttagtttttggctcctgcgtgacaaacaggttaattgcttttgttaaaaatcgagtgggtgctgtgcggttgatggttctgagacaacagtaccagtcagttaggacaactggtgagaccaaataatacttgatatcaaaattctaagattagaattatttaataggagaagacaggaatgaaaagaaaattatataaattctaggtttaaaaatataaaaattaaaaaaataaaccccaaaaggccacagacccagggctaagcctgcagccaagactagcaggccataaagataaaggagcacaggaaacactgttcaggcaggactgacaagccataaaaaaaggaatgcaggaaccagcctgagttaatgagactgattcatgggacgtctggcaggaagacatctcccccagctcactcagggccatatttcaactaggtgtcctccggcccctgataagcccctgacttctagcacgttactctttctgctttgttctcactgctatgtttgaatgagccaattgtatgtaaccacgccaaaacccctagccttctctatataaccctctgacttttgagtttcggggccgacacctctgtctcctgcgtgggatgcgtgtcggcccggagatctctgtaataggtctccgtaataaacctcgcctttgcttattacatcc

SEQ ID NO: 4453 - DNA, 1508 bp, Rattus norvegicus
  Genbank Accession No. X63594
cccaactgccagcagcctgcaccctgcacccgctcagctccgcacagccatgtttcagccagctgggcacggccaggactgggccatggagggcccgcgggacggcctcaagaaggagcggttggtggacgaccgccacgacagcggcttggactccatgaaggacgaggattacgagcagatggtgaaggagctgcgggagatccgcctgcagccgcaggaggcgcctctggctgccgagccctggaagcaacagctcacggaggacggagactcgttcctgcacttggcaatcatccatgaagagaagacactgaccatggaagtgattggtcaggtgaagggagacctggccttcctcaacttccagaacaacctgcagcagactccactccacttggctgtgatcaccaaccagccaggaattgctgaggcacttctgaaagctggctgtgatcctgagctccgagactttcgaggaaatacccctctccatcttgcctgtgagcagggctgcctggccagtgtagcagtcttgactcagacctgtacgccccagcatctccactccgtcctgcaggccaccaactacaacggccacacgtgtctacacttagcctctatccatggctacctgggcatcgtggagcacttggtgactttgggtgctgatgtcaacgctcaggagccctgtaatggccggacagccctccaccttgcagtggacctgcagaatcctgacctggtctcgctcctgttgaagtgtggggctgatgtcaacagagtaacctaccagggctactccccctaccagcttacgtggggccgcccaagtacccggatacagcagcagctgggccagctgaccctggaaaatcttcagacgctgcccgagagtgaggatgaggagagctatgacacggagtcagaattcacggaagatgagttgccctacgatgactgtgtgtttggaggccagcgtctgacgttataagaggaaagtggccaaaggaacgtggacttgtatatttgtacaaatagagttttatttttctaaaaaaaaaaaaaaaaaagaaaaagaaaaaaaataagaaaggatacttagcaccacagcacacagcgcctagccccgagcattctattgtggtgattcagctgttgttcttctcaaatttggggaaacagatcattgaaattcaaaggaaatgtctcctaaggttcatgtttgtgggattttttttttttttttgaggtgattttccagaatctgataaaaggaccacatttaatttatgtgcttttggttgaaccgccatagacgtagctgaccccagttgccctctacgtaagaaccaggtcgatagtggtatgtgcttaagcaccccagctgagatttgtaccactttcttgtaaatgttgtatatggatgtattttgttggtaattatttttggtacttctaagatgtatatttattaaacagatttttacagtatcaaaaaaaaaaaa

SEQ ID NO: 4454 - DNA, 3774 bp, Rattus norvegicus
  Genbank Accession No. X65036
ttcaacctggatgtgatgggtgccatacgcaaggagggagaacctggcagcttattcggcttttcggtggccctacaccgacaattacagccccgaccccagagctggctgctggtgggtgccccccaggccctggactcttacccggacagcaggcaaatcgcacatgggaggcctctttgcttgtccctgagcctagaggagacagactgctacagagtggacatcgacaggggagctaatgtgcagaaggaaagcaaggagaaccagtggctgggagtcagcgtgcgaccgagggagtccgggggcaaggttgttacctgtgcacaccgatatgagtctcgacaggaagtggaccaggttttggagactcgagatgtgattggtcgttgctttgtgctgagccaggacctggccatccgtgatgagttggatggtggggagtggaagttctgtgaagggcgcccccagggccacgaacaatttgggttctgccagcagggcacagctgccaccttctcccccgacagccactacctcatttttggggctccaggaacctataactggaagggcacagccagggtggagctctgtgcgcagggctcgtcggacctggcacaggtggatgatgggccctacgaggcggggggcgagaaggaccaagacccccgtccttcaccggtccctgccaacagctaccttggtttctccattgattctgggaagggtctcatgcgctcagaagagctgagttttgtggcaggggccccacgtgccaaccacaaaggggctgtggtcattctgcgcaaggatagtgccagccgcctgattcctgaggttgtgctgtctggggagcgcctgacctctggctttggctactccctggctgtgactgacctcaacagtgatggctgggcagacctgattgtgggtgctccctacttctttgaacgccaagaagaacttggaggagccgtgtatgtgtacatgaaccagggtggccattgggcagatatctctcctctccgactctgtggctcccctcactccatgtttgggatcagtttggctgtactgggggacctcaatcaagatggcttcccagacattgctgtaggagctccctttgatggagatgggaaagtctttatctatcatgggagcagcctgggggtggtcaccaaaccttcacaggtgctggagggtgaggctgtgggtatcaagagctttggttactccctgtctggtggcctggatgtggacggaaatcactacccggacctgcttgtgggctccctggctgatactgctgctctgttcagggccagacctgttctacatgtctcccaagaaatcttcattgatccaagagccatcgatctggaacagcccaactgtgccgacggacgcttggtctgcgtgcacgtaaaggtctgtttcagttatgttgctgtgcccagcagctacagccctattgtggtcctagattatgtgttagatggggacacagaccggaggctccggggccaggctccacgtgtgactttcccgggccgaggcccggatgatctcaagcatcagtcctcgggcaccgtgtcgttgaagcaccaacatgacagagtctgtggagacacatgtgttccagctgcaggaaaacgtaaagacaagctacgggccattgtggtgaccctgtcatatggtctccaaacccctcgattaaggaggcaagcgcctgaccaggggctcccccttgtggctgggatcctcaacgctcaccagcccagtacacagaggactgagatccacttcctgaagcaaggctgtggtgacgataagatctgtcagagcaacctccagcttgtgcaggcccagttctgttcccggatcagcgacacagagttccaggctctgcccatggatctggatgggaccgccctgtttgcgcatggcgggcagccattcataggcctggagctgacagtcaccaacctgccctctgacccagcccggcctcaggcagatggggatgatgctcatgaagcccagctcctggccaccctcccagcctctcttcgatactcgggagtccgcactctggactctgtggagaagccgctctgcctgtccaacgagaatgcctctcatgtcgagtgtgagctcgggaaccctatgaagagaggcactcaggtcaccttttacctcatcctcagcacctctggaatcaccattgagaccacagagctgaaggtggaattgctcttagccacgatcagtgagcaggacctgcatccggtctccgttcgggctcatgtcttcattgaattgccgctgtccatttcaggggtggccactcctcagcaactcttcttctctggcaaggtgaagggggagagcgccatgcggtctgagtgggacgagggcagcaaggtcaagtacgaggtcacggtctccaatcaaggccagtcactcaatactctgggctctgccttcctcaacatcatgtggccccatgagatcgccaatgggaaatggctgttgtaccccatgcgggtggagctggagggtggacaggggcctgagaagaaagggatctgctccccaagacccaacatcctccacctggatgtggacagcagggataggaggcggcgagagctggggcagccggagcctcaggagcctccagagaaggtggaacctagcacatcttggtggccagtgtcctccgctgagaagagaaacgtgactctggactgcccaggcacggccaagtgtgtggtattcagctgcccactctacagctttgaccgtgcagccgtgcttcatgtctggggccgcctctggaacagcacctttctggaggagtacatgtccgtgaagtccctggaggtgatcgtccgagccaacatcacagtgaaatcctccattaagaacttgctgctcagagatgcatccacagtgatcccagtgatggtatacttggacccggtggctgtggttgcagaaggagtcccctggtgggtcatcctcctggcggtgctggctgggctgctagtactggccctgctggtgctgctgctgtggaagctgggattcttcaagcgggcgaagcaccctgaggccactgtaccccagtaccacgcagtgaagatccttcgggaagaccggcagcagttcaaggaggagaagacaggcaccattcagaggagtaactggggcaattcccagtgggagggctccgacgcacaccctatcctggctgccgactggcaccctgagttgggtcctgatggacatcctgtgtcagtcactgcctaacttctcctgtcccaagccagcctctgggttccttccaccctttcccaagatggctctttgggggtggagatagtggagtaggttgctggcttcatgttgaaataaggcaggttctgctttctcaggggcacagatctttcccaccgtgagaaccaccccttcccatcttctccgtacaatgctgtgagacacggggcatggctggaaggacaggcatgacctggtgcaggatggagaagaaggggtactgagctgcctctctcacccaccctgtaagaccgtcttccccaaagtgccttagacagagggtcagggaagagatcgtgtcactgtctcaggggcccttccctcctaagtctttcctgtgctctggccttagtgtgctgtaccagcccagcggatcttgtctatttattaaaaagtatttgacaataaaaaaaaaaaaaaaaaaaa

SEQ ID NO: 4455 - DNA, 534 bp, Rattus norvegicus
  Genbank Accession No. X65228
ccttttttcgccaagatggcgccgaaagcgaagaaggaagctcctgcccctcccaaagccgaagccaaagcgaaggccttgaaagctaagaaggcagtgctgaaaggtgtccacagtcacaaaaagaagaagatccgaacgtcacccactttccggcggcccaagaccctgcggctccggaggcagccaaaatatcctcgaaagagtgcacccaggagaaacaagcttgaccactatgctatcatcaaattcccactgaccaccgagtcagctatgaagaaaatagaggacaacaacacgcttgtgttcattgtggatgttaaggccaacaagcaccagatcaaacaggccgtgaaaaaactctatgatatagatgtggccaaagtcaatactctgatacggcctgacggagagaagaaggcatatgttcgcttggctcctgattatgatgctctagatgttgccaacaagattgggatcatctaaagtgagtccagatggttaattctaaatatatactttttttccaccata

SEQ ID NO: 4456 - DNA, 1489 bp, Rattus norvegicus
  Genbank Accession No. X67788
caagattgccctgctggaggaggcacggaggcgcaaggaggacgaggtggaggagtggcagcaccgggctaaagaggcccaggacgacctggtgaagaccaaagaggagctgcacctggtgatgacggctcccccgcccccacccccgcccgtgtacgagcccgtgaattaccacgtgcaggaggggctgcaggatgagggagcagagcccatgggctacagtgccgagctctccagcgagggcatcctggacgaccgtaacgaggagaagcggatcaccgaggcagagaagaacgagcgcgtgcagcggcagccgttgactctgagcaatgagttgtcccaggcccgggatgagaataagaggacccacaatgacatcatccacaatgagaacatgcggcaaggccgggacaagtataagacgctgcggcagatcaggcagggcaacaccaagcagcgcatcgacgagtttgaggccatgtagaggccaggccgggaccaagggcggagggcacctcacagcaggcaggtgtcactcttggctctttagtactctataagtctagaaacccccttgccgtgttccagtcccttaaagagcaggtaccgggcgatgttctgccccaagacccagtggaatcctccctggttgcttccaatagtatcacatagtgccaaacaggccagatttttatgacagttgccgaatcacttcccgttcggagcagggattcggagggctggcccgaatgacgcgattcagtgtcactggggataataatagcactgtggctcacacacgggtgccatactttctctagttttacaatgagctcaaatcgattttgttcttgatttctatgaaggatccatctctgtgtgttgaggggtgaaaatgattttgaaatttgagtcttaagacgccccacacagtctccttcctccagaccgctggcagagtctcctgcggtccctcagagtgtacggtacaggactctccgatacaaaattctcatgcttaccctgttagcattcattgttggactgatacacctaatgatcttctatagagaatagtatttatatataagcgataatatgggtttgtaacattagttttaaaaagggaaagttttgttctgtatattttgttaccttttacagaataaaagaattcaacattaagaaccagtaatcacgacacttgatctgacacgggggcaggtgggagaccgatgaccggaatcgccgctgtacaaaaatgttagtgggttttgtgcatgtaaaacgcacacttcaacttcctgtcagttcttcactgagagcagtcagactctagcccgaagggactcaggcctgtttattgtgaacaacttgttcctgttttcagtttgtcttccttccttgagccggactgtcctttttggttgtgatgtcctgtgcaggtcactccgcaccagatttacacacaataaaagttctccaaggc

SEQ ID NO: 4457 - DNA, 1526 bp, Rattus norvegicus
  Genbank Accession No. X67877
ctctcctgaccctgcgcgccgcgggaagatggcgcttgaagctggcgacatggaagagggacagctttccgactcggattccgacatgacggtcgtccccagcgataggcctctgcaaatggcgaaagtactaggtgggggcggtgctgcatgcgcaccagtgtcaaactatcggactgttaaacatgtggactccagtgaggagagtctggattccgatgacgattgctctctttggaaacgtaagcggcagaaatgtcacagtcctcctcccaagccagagcctttcccatttggacagagcggtcagaaacaagctctcaacggtgggaagaaggtgaacaacatctggggtgctgtgctacaggaacagaaccaagatgctgtggccactgagctcggcatcttgggaatggaaggcaccatcgacagaagcaggcagtctgagacctataattatttgcttgctaagaaacttgctaagaaggaatctcaagagtatacaaaagaattagacaaagatctggatgagtatatgcatggcgacaaaaaacctgggtcaaaggaagaggagaatgggcaaggtcatctcaaacggaaacggcctgtccgagacagactgggtaacagagtagaaatgaactacaaaggccgctacgacatcacagaggaggattctcccgagaaagtggctgatgagattgccttcaggttacggaaccgaagaaggacctgatagcccgagtagtgacgatacttgggaacaaaaaggccattgaacttctgatggagacggctgaggttgagcaaaatggtggccttttcataatgaatggaagccgaaggagaacgccgggtggggttttcctcaatctcctgaagaacacgcccagcatcagcgaagagcagatcaaggatattttctacattgaaaatcaaaaagaatatgaaaataaaaaagctgctagaaaaagaagaacacaactattggggaagaaaatgaaagaagctattaaaagtctaaatttccaggaagatgatgacacatctcgagaaacgtttgcaagtgacactaatgaggccctggcctctcttgacgaagcccaggaaggacccggtgaaaccaagctggatgctgaggacgccatcgacgtggaccaccctcaggatttggacatcttttaagcacactttggacattttgaagcaataaacctttgttttttaaaaaaggtgttaccaatttctactgaggttgctttactgtgcaccgacactgaggcgggagagctgtgtctgtgctcccgtgaagtagtaatgtatgtggtagtcgtgccgtcgccgcagtgtggaaggtggctgcatctgacggctgctgtacagcacgggctaatttctctactctgcatgtgctgactgttagcctacgtggagctgtgtcctctctgtccagctcactgtttcatgccagtaagacattttggttttctcattcatctttgtggtgaactatgctttggttttaa

SEQ ID NO: 4458 - DNA, 3227 bp, Rattus norvegicus
  Genbank Accession No. X68101
taagctgtcacgtggacatagtccactcatgaagaaagtttttgatgtctacctgtgtttcctccaaaagcatcagtcagaaatggctttaaaaaatgtcttcactgccttaaggtcattaatttataagttcccctcaacgttctacgaggggcgggcagacatgtgcgcatctctgtgctatgaggttctcaagtgctgtaactccaagctcagctccatccgcaccgaggcctcccagctgctctacttcctgatgaggaacaacttcgactacacagggaagaagtcttttgtccggacacacttacaggtcatcatctctctcagccagctgatcgcagacgtggttggcattggaggaaccagattccagcagtccttgtctatcatcaacaactgtgccaatagcgaccggctcattaagcacaccagcttctcctctgatgtgaaggatttgaccaagaggatccgcacagtcctgatggccacagcccagatgaaggaacatgagaacgacccagagatgctggtggacctgcagtacagcctggccaagtcctacgccagcacccctgagctcaggaagacatggctggacagcatggcaaggatccatgttaaaaatggggatctctcagaggcagcaatgtgctatgtccacgtgacagctttggtagcggaatatctcacacggaaagaagctgacctagcactccagcgggaaccacctgtcttcccctacagccatacctcctgccagaggaagagccggggaggcatgttcagacaggggtgcacagccttcagggtcatcacaccaaacattgatgaagaggcttccatgatggaagatgtcggcatgcaggatgtccatttcaatgaggatgtgctgatggagctgctggagcagtgcgcagatggactttggaaggcagagcggctacgagctggattgctgacatctataaactcatcatccccatctatgaaaagcggagggactttagagactacccacctgtatgacaccctgcaccgcccatacagcaaagtgacagaggtcatcactcgggccgcaggctcctgggacctacttccgggtggcctcttcggacagggattcttcgaagatgaagacgggaaggaatacatctacaaagagcccaaactcacgcctctgtcagagatttctcagagactccttaaactttactcggataaattcggttctgaaaatgtcaaaatgatacaggattctggcaaggtcaacccgaaggatctggattccaagtttgcttacatccaggtgacccatgtgaccccgttctttgatgaaaaggagttacaggagaggaaaacagagtttgaacgatgtcacaacatccggcgcttcatgttcgagatgcccttcacccagactgggaagaggcagggtggcgtggaggagcagtgtaagcgacggaccatcctgacagcaatacactgcttcccctatgtaaagaagcggatccctgtcatgtaccagcaccacactgacctgaaccccattgaggtggccatcgatgaaatgagcaagaaagtggccgagctccaccagctgtgttcctcagctgaagtggacatgatcaaactgcagctcaaactgcagggcagtgtgagcgtccaggtcaatgctggcccgctagcatacgcccgagccttcctcgatgacaccaacacaaagagataccctgacaataaggtgaagctgctgaaggaagttttcaggcaattcgtggaagcttgtggccaagccttggcagtgaacgaacgtctgattaaagaggaccagctggagtaccaggaagagatgaaagccaactacagggagatccggaaggagctctccgacatcatcgtgccgagaatttgccctggagaggacaagcgtgctaccaaattccctgcacatcttcaacgccatcagcgggacaccaacaagcacagtggttcaagggttgaccagttcatcctcagttgtgtgactttacctcatgaaccacacgtggggacatgctttgtcatgtgcaaactcaggacgactttcagagctaatcactggttttgccaagcacaggaagaagccatggggaatgggagagagaaagagccctggactgtgatatttaatagcagattttataggagttgggggaaggtgcacatatttttttaaatctcactggcaatgtttagttttcctcatgtcttaacaggtgtatgtggatactcttgggctgcagttcaattttattcttcttacagtatagtattaaaataaatggtctaaaggaaaagagggaaagtatgctgggacacctgtagcaggtgtgctgggacacctgtaccagctgtgctgggacacctgtaccagctgtgctgggacacctgtagcagatgcagcagcactgaacctgggaatggggactaagctggaaaaatcttgaaaatatttttctccctgtggcacattcaggttgagtacaagaactatttttgtgtctagttttgaagactgaaaggaattgactattgagattttttactagtgaatgcggagacttagagcctttatatccatgccttgtgttgacaacatgagcacttccgaagctgagtgtgatgtgagcctaagcctagtcagcagcatagaaccaaaggcctgcactagcgaacacacctatgctaaaacctaaaaccccatgtacatatgttctgttaatacggcctcctcgctgagtccacgtacttactacatttctacacttttaatacatcagtgtccgtgttaagtttattattcgtgacccatttgtgctgttctcggtatatgcaaatacattggacttcactgtttattcttgtacataagaagtgcaatatggagatgtatacagtctttgctatgttaggtttataaactgtttttaaaaagaaattcatccttttgccaaaatggtggagtatgtgattggtaaaccctaaaccctgtggtgagtggagggataatttaaagttttcaccatgttatattttcttttaagactttaatttagtaattttatatttgggaaaataaaggtttttaatttaactggaatcactgccctgctgtaattacatatcatgtaccccaactgtattaaaaataacactgctgattttctggtaaaaaacgaaaaaaa

SEQ ID NO: 4459 - DNA, 1565 bp, Rattus norvegicus
  Genbank Accession No. X69834
cttttctcctgatggctgggatctgccctgctgtccttggcttcccagatggcacactgggaaatgacactctactccataaagatcaagacaaggggacacaactggacagtctcacattggagtccatcaacactgactttgccttcagcctttacaagatgctggctttgaagaatccagataaaaatgttgtcttctccccacttagcatctcagctgccttggccattgtgtccctgggagcaaagggcaacaccctggaagagattctagaagttctcaggttcaatctcacagagagctatgagacagacatccaccagggctttgggcacctcctccagaggctgagtcagccaggggaccaggtaaagatcatcacaggcaatgctctgtttattgataagaaccttcaggtcctggcagagttccaggagaagacaagggctctgtaccaggttgaggccttcacagctagcttccagcagcctcgtgtgaccgaaaagctcatcaatgacagtgtgagaaatcagacccaggggaagatccaggaactggtctcaggcctgaaagagaggacatccatggtgctggtgaacatcctcctctttagaggcaaatggaaggtgccctttgaccctgattacacatttgagtctgagttctacgtggatgagaagaggtctgtgaaggtgtccatgatgaaaattgaggaactgactacaccttacttccgggatgaggagctgtcctgctctgtgctggaactgaagtacacaggaaattccagtgccctgttcatcctccctgataagggcaggatgcagcaagtggaagccagcttgcaaccagagaccctgaagaagtggaaggactctctgaggcccaggaagatagatgagctctacctgcccaggttatccatttccactgactatagcctggaggaggtccttccagagctgggcattagggatgtcttctcccaacaggctgatctgagtaggatcacaggggccaaggacctgagtgtctctcaggtggtccacaaggttgtgctggatgtgaatgagacaggcacagaagcagctgctgccacaggagccaatttggtcccacgtagtggaaggccacctatgattgtgtggttcaacaggccattcctgatagctgtctctcacacacatggtcagcatatcctctttatggccaaagtcattaaccccgtgggagcctaaagctcccaatatctaatagttctacccaggtccatgagaccgagcctgcatgtggatctctgtgtataacccaaccttcaaactctgattggctgttgcaaagttggcttagacagtgacatcgactatctctgtggctcccagacattcaggagcgtttggactgtaatgtcaggttctcaggcccttgggagcatctgcacatgtttctgaacctggaatctgtcttttttcttcttcccttgtgactcctctttctgtgttcataccccaaacctagccactgtcaagtacacccagtcccaataaaggctttgagcaccg

SEQ ID NO: 4460 - DNA, 1959 bp, Rattus norvegicus
  Genbank Accession No. X70706
ccacctataatttattccacctctggcaaaggactgcaaaggcagccaggaaggagattcatcttcacatggacgagatggcaaccactcagatttccaaagatgagcttgatgaactcaaagaggcctttgcaaaagttgatctcaacagcaatggattcatttgcgactatgaacttcatgagcttttcaaggaagcgaatatgccattgcccggatataaagtgagagaaattattcaaaaactcatgctggatggcgacagaaataaagatgggaagataagctttaatgaatttgtttatattttccaagaggtaaagagcagtgacattgctaaaaccttccgcaaagccatcaacaggaaagaagggatttgtgctctgggaggaacttcagagttgtccagtgaaggaacccagcattcctactcagaggaagaaaaatatgctttcgttaattggataaataaagctttggaaaatgatcccgattgcagacatgtcatacccatgaacccaaatactgatgacctattcaaagcagttggtgatggaattgtgctctgcaaaatgatcaacctttctgttcccgatacaattgatgagagagcaatcaataagaagaagcttacacccttcatcattcaggaaaacttgaacttggccctgaattctgcttctgccattggatgtcacgttgtgaacattggtgccgaagatctgcgtgccgggaaacctcatctggtcttgggactgctctggcagattattaagattggcttatttgctgacattgaattaagcaggaatgaagcactggcggctttgcttcgagatggtgagactctggaggagcttatgaaattgtctccagaagagcttctgctgagatgggccaacttccatctggaaaactcaggctggcaaaagatcaacaacttcagtgctgacatcaaggattccaaagcctatttccatctactcaatcaaattgcaccgaaaggacagaaggaaggggaaccacggatagatattaacatgtcaggtttcaacgaaacagatgatttaaagagagccgaaagtatgcttcagcaagcagataaattaggctgcagacagttcgttaccccggctgatgttgtgagcggaaaccccaaactgaacttggcctttgtagccaacctctttaataaatatccagcactaactaaacctgagaaccaggatattgattggactcttctagaaggagaaactcgtgaagaaagaacctttcgtaactggatgaactctcttggtgtgaatccccatgtcaaccatctctatgttgacctgcaggatgccctggtgatcttacagctgtatgagagaattaaagttcctgtggactggagtaaagttaacaagcctccatacccaaagctgggtgccaacatgaaaaagttagaaaactgcaactatgcagttgaattagggaagaatcaggctaaattctccttggttggcattggaggacaagacttgaatgatgggaacccaaccttgaccttggctgtagtctggcagctgatgagaagatatacccttaatgttatggaagatcttggagagggtcagaaagcaactgatgacatcattgtaaactgggtcaatggaacattgagtgaagctggaaagtcaacttctattcagagttttaaggacaagacgatcagctccagtttggcagttgtggatttaattgatgccatccagccaggctgcattaactatgaccttgtgaagactggaaatctaacagaagaagacaagcacaataacgccaagtatgcagtgtcgatggctagaagaataggagccagagtgtatgctctccctgaagaccttgtggaagtaaaaccgaagatggtcatgaccgtgtttgcctgtttgatgggcaggggaatgaagagtgtaa

SEQ ID NO: 4461 - DNA, 3551 bp, Rattus norvegicus
  Genbank Accession No. X76456
gtgtcctctgtctctgtctctgtctctgtctctgtctctgtctctgtctctgtctctgtctctgtctctgtctctctctctctctctctctgtgtgtgtgtgtgtgtgtgtgtgtgtgtgccttagagtctcttagactggctggcctgagagtcacagggaactacctagctacacttctcagtactgggatgagaggtgtgcattagaatgcctgcgttttacacgagctctggagactaaactcaaatcttcctacttgccaggcaagcagttaatgtcattatactgcatttccattttgatgtgttagctagtcatttctcttttaacatttggagtattttataactttggaggtagggctattcttaccctgtgaactgcttttcctctctctctctctctctctctctctctctctctctctctctctctctctctctctctcaagtcaagagattcccccctccgcatcattttcccctagttaataattaccaagaaatttgcaccaagaccaaaaaaagcctatgtatttcagaaatagattaactaggttactttttaacaaagcttaggtcaaagaatactataaaacgttggttttgccccagtcgcattactctcttgaatgtggcctcttttttaaatttaaacatgagacacttaaaacttacaggttttatttttttcctgttgtctttgactgaatccctagccctacccacaaagcctcaggatgtaggtaagaaatttacttgtgtattaccagggacaactaagtgaaggaaattactttcctttagccttttaaaactttgattattccggtggttttatttttctctctcttctcttagtatatgtatactggtcagtagtttcaaaggacccactacagattttcatattatctattctgtaggatgcttgcctttagaaacggccaacaatctggatcatgttgacttgagatgtaatttggacttcaaaaatattagaattttgtgacagatatagatatataaatatatgtatagtccaacagaagagcatagatacagtatatacatattcatacatatacatacatacacacatatgtacacactcacacacaaacacatgtataaacatttatatacaatctttaaaaaatattttttaaatatttttggttgtccaatatgtcttccagctagatgataaataccgtcaggtatatgagatcctgctttctccttcagctggcgttacacacctgcaacatactacgccaagagcaaggcgtgtcaaccgggtggaaaaggcaatttttacattttaccaaatgaggaaactttgaaattttctttgaaagaaaagaaaattttctttgaaaggtctttttaaatacctctggccagaaaggcacattttttttttacaggaatgtagtttccttaatatcatcccagagaacatatactcaagtgatattatacagactgataaggttgtatctatgtatcagagaatgtaaaaatttataatatatataacatcaatcaatcaattaatgaaaaagaggccatgcatttgaaagagagcaaggaggggttaacaggagaacaggcaggggatcatttcaatgctactcagaaattcataaatgagaacgttgcatacctgaccatcattgcatctgcccagtatgttcaggaagcatcctttgaggaggtggaaatgctggtgaaggtcatgctggattacaaggataggtgcttggctgacagcacacttccggagtgttcaaagatagctaatgatgctatccaggacatgctctgtgatatgaaggggctgccacagaagcataacttctcccattgctgtaggcaagccggctttcaaagaagactctgcttcttctacaacaagaaagctaatgtaggatttctgccccctttccctactctggatccagaagagaaatgccaagcttataaaaataacagtgaatcttttctcaacctctatatgtatgaggtggccagaaggaacccctttgccttcgccccagttcttctgaacgttgccgctaggtttgaggaggcggcgaccacgtgctgtgaacagcaacagaaagccacctactttcaagacaaggcagcccccatcacacagtatttaaaagcgttatcttcttatcaaagaaatgtttgtggagcccttttaaaatttggacccaagaccttaaactctataaacatcgccgtgtttagtaagaagttccccaagattggatttgaagaccttacgtccctcttagaagatgtttcttccatgtatgacgggtgctgtgaaggggacgtcgtgcagtgcatccggagccagagccaggttatgcaccatatttgttcaaaacaagactccatctcaagtaagatcaaagcgtgctgtgagaagaaactgccagagcgcgcagactgcataatcaacgcaaacaaggatgacagaccagaagacttatctctgagaacacccaaatttaccgacagtgaaaatgtgtgccaagagcgagattccgagcaggacaagttctttgctgagtttctttatgattactccagaagacatactgaactgtctacaccagagctcctaagaattactaaagtgtataaggatctcctggaagattgctgcaacagaaaaaacccgttaagctgttaccgccatgcggaggataagttcaacgagacaacagagcgaagccttgcgatggtccagcaagagtgcaaacagttccaggaattggggaaggacgctctacaacgccatttccttgtcaagttcaccaaggcagcccctcaactccccatggaagaactggtctcccttagtaaggaaatggtggcggctttggcaacctgctgcactctcagtgacgagttcgcctgtgtggacaacttggcagatttagttcttggagaattatgtggaatgaataagaatcgaactatcaatcccactgtggatcactgctgcagagctgactttgccttcaggagaccctgctttgagcacctgaaagccgacaccacctatgcactcccatcagtctctgcacttgtatctgctttgcgtgcagactggtgtcagcctctcaaggaggaccttcagaataagagacacaggtttctggtcaacttagtgaagtggatgccagagatcacagatgaggaacgtctgtgtttgttcacaaagttcacggctgctggggaggagtgtggcaacatacagaagcctgaggcctgtttcagtccagagagttcaaaaaccggtgatgtgagtcaagatgcagagaaacaaaggtgaacggaatgaccagagccagtaccagctcacaggatcgtcctgtggagaagttcagctcttaagaagactggaatagaaggtccttctgtaaccctttcttgaatcatgttcctacaaaaggcaataaaaagggaggataaagtttctcgcggcgcgaaaaaaaaaaaaaaaaaaaaaaaaaaaaaaaa

SEQ ID NO: 4462 - DNA, 678 bp, Rattus norvegicus
  Genbank Accession No. X76489
atgccggtcaaaggaggtagcaagtgcatcaaatacctgctctttggatttaacttcatcttctggctcgccggcatcgcagtgcttgccattggactatggctgcggttcgactctcagaccaagagcatcttcgagcaagaaactaatcattccagcttctacacaggagtgtacattctgattggagctggggccctcatgatgctagttggtttcctgggctgctgtggagctgtacaagagtcacagtgcatgctgggattgttcttcggattcctcttggtgatattcgccattgagatcgccgcagccgtctggggctatacccacaaggacgaggtgattaaagaactccaggagttttacaaggacacctaccaaaagttaaggaacaaggatgagccccagcgggaaacactcaaagccatccatatggcgttgaactgctgtggcatagctggtggtgtggagcagtttatctcggacatctgccccaaaaagcaggttctggaatccttccaggttaagtcctgcccggatgccatcgatgaggtcttccacagcaagttccacatcattggagcagtgggcatcggtatcgccgtggtgatgatcttcggtatgattttcagcatgattctgtgctgcgccatccgcaggagccgagaaatggtc

SEQ ID NO: 4463 - DNA, 1969 bp, Rattus norvegicus
  Genbank Accession No. X77934
agacgcttctgggtcgcgttagggagacgctctggtccggttgtgcgtgagaggaggagagcccagcgccacagcgacccggagagggatggcggccaccgggaccgcggccgctgcggccaccggcaagcttcttgtcctgctgctgctcgggctcacggcacccgcagcggctctggctggctatatcgaggctctcgcagccaatgctggaacaggctttgcggttgctgaacctcagattgcgatgttctgtgggaagctgaacatgcatgtgaacattcagactgggaagtgggagcctgacccaaccggcaccaagagctgcctgggaacaaaggaggaagttcttcagtactgccaggagatatatccagagctgcagatcacaaatgtgatggaagcaaaccagccagtcaatattgatagttggtgccgaagggacaaaaaacagtgcaggagtcacattgttataccattcaagtgtcttgtgggtgaatttgtaagtgatgttctgctagttccagaaaactgccagtttttccaccaagagcggatggaggtgtgtgagaagcatcagcggtggcacacagtcgtcaaggaggcatgtctgactgaggggatgaccttatatagctatggcatgctgctgccctgtggggtagaccagttccatggcactgagtatgtgtgctgccctcagacaaaggttgttgactctgactccactatgtccaaagaagaggaggaagaagaggaagaggatgaagaagaagactatgctcttgataaaagtgaatttcctaccgaagcagatctggaagacttcacagaagcagctgcagatgaggacgaggatgaggaggaggaggaggaggaggaaggggaggaagtggtagaagaccgtgattactactatgactcctttaaaggagatgattacaatgaggagaacccaactgaacccagcagcgatggcaccatctcagacaaggagattgctcacgatgttaaagctgtctgctcccaggaggccatgacggggccctgccgggccgtgatgcctcgttggtacttcgacctctccaagggaaagtgcgtacgctttatatatggcggctgcggcggcaacaggaacaattttgagtctgaggattattgtatggctgtgtgtaaaacgatgattcccccgactcccctgccaaccaatgatgtggacgtgtattttgagacgtcggctgatgacaatgagcacgcccgctttcagaaggctaaggagcagttggaaattcggcatcgcagccgaatggacagggtaaaaaaggagtgggaagaagcagaacttcaagccaagaacctccccaaggcagagcgacagaccctcattcagcatttccaagctatggttaaagccttagagaaggaagcagccagtgagaagcagcagcttgtggagacccatttggcccgagtagaagcaatgctgaatgaccgtcggcgcatagctctggaaaactacctggctgccctgcagtctgaccctcctcggccacatcgcattcttcaagctcttcgtcgttacgtccgtgctgagaacaaagatcgcctgcacaccattcgtcattaccaacatgtgttggctgttgacccagaaaaggctgcgcagatgaaatcccaggtgatgacacacctccatgtcattgaagaaagaaggaaccaaagtctctctctgctgtacaaagtgccttatgtggctcaagagattcaggaggaaattgatgagctccttcaggaacagcgagcagatatggaccagtttacctcctccatctcagagaaccctgtggatgtccgggtgagctctgaggaaagtgaggagatcccgccgttccaccctttccatcccttcccatccttgtctgagaacgaagacactcagccggagttgtaccacccaatgaaaaaagga

SEQ ID NO: 4464 - DNA, 1838 bp, Rattus norvegicus
  Genbank Accession No. X78949
gaattccgcgggattccgccttcctcacggcccgctatccaggtgtgtgaacctgtggggtgctccaagatgatctggggtgtattaatgatggggattctacttcctcagtgttcagcccatccaggcttttttacttcaattggtcagatgactgacttgatccataatgagaaagacctggtgacgtcactaaaagattacattaaagcagaagaggacaagttagagcaaatcaaaaaatgggcagagaagttagaccggctaacaagtacagcaacaaaagatccagaagggtttgtcggacaccctgtaaatgcattcaagttaatgaaacgtctgaacaccgagtggagtgagttggagaatctgatcctcaaggatatgtcagatggcttcatctctaacctgaccattcagaggcagtacttccctaacgacgaagaccaggttggggctgcaaaagctttgtttcgtctgcaagacacctacaacctagacacgaataccatctcgaagggcaatcttccaggagtgaaacacaagtcttttctaacagctgaggactgctttgagttgggcaaagtggcctatacagaagcagattattaccacacagaactctggatggagcaggctctgatgcagctggaggagggagagatgtctactgtagacaaagtctcggttctagattatttgagctatgcagtgtaccagcagggtgacctggataaggcacttctgcttacaaagaaacttcttgaactagatcctgaacaccagagagccaatggtaacttagtatattttgagtatataatgagtaaagaaaaagatgccaataagtctgcttcgggtgagcgggctgatcagaaaactacaccaaagaaaaaggggattgctgtggactacctgccagagagacagaagtacgaaatgctgtgccgtggggagggtatcaaaatgactcctcggagacaaaaaaggctgttctgccgctaccatgatggaaaccggaatcctaaatttatcctggccccagccaagcaggaggatgagtgggacaagcctcgcatcattcgtttccatgacatcatctcagatgccgagattgagatcgtcaaagatttagcaaagcccaggctgagccgagctacagtacatgaccctgagactgggaaattgaccacagcacagtacagagtatctaagagtgcttggctgtctggctatgaagatcctgtggtgtctcgaattaatatgagaatacaagatctcacaggactggatgtttccacggcagaggaattacaggtagcaaattatggagttggaggacagtatgaaccccattttgactttgccaggaaagacgagccggatgcttttagagagcttgggacaggaaataggattgccacgtggctcttctacatgagtgatgtgtctgctggaggcgctactgtttttcctgaagtgggagccagtgtttggcccaaaaaaggcactgctgtcttctggtacaatctgtttgccagtggagaaggagattacagtacacggcacgcagcctgtcctgtgctagtgggaaacaaatgggtatccaacaaatggctccatgaacgtggacaggaatttcgaaggccgtgtaccctgtcagaattggaatgacaaccaggcttcccgtggctcctctcgtcctctaacgcaccaggcatgatcgctgactgtaacattcagaagtttacagctgactaacactccatgattaattcggccgtgaaccccatcccatgtttcatctgtggacaatcacttatttttgtgaatttttt

SEQ ID NO: 4465 - DNA, 1374 bp, Rattus norvegicus
  Genbank Accession No. X80130
aggcctgccaccagcgccagcccagctgaacccagccgcccaaagcacgcctacagatcccacagaagctgtaccaggatgtgtgacgacgaggagaccacagctttggtgtgcgacaatggctccggactggtgaaggctggctttgcgggtgatgatgctcccagagctgtcttcccatccatcgtgggtcgcccacgccaccagggtgtcatggtaggtatggggcagaaagactcctatgtaggtgacgaggctcagagcaagcgaggcatcctgactctgaagtaccccatagagcacggcattatcaccaactgggacgacatggagaagatctggcaccacaccttctacaatgagctccgtgtggcccctgaggagcacccgaccctgctcactgaggccccactgaaccccaaggccaaccgtgagaagatgacacagatcatgtttgagaccttcaatgtgcctgccatgtatgtggccatccaggcggtgctgtccctgtacgcttctgggagaaccacaggcattgttctggattctggcgacggtgtgactcataacgtccccatctatgagggttatgccttaccccatgccatcatgcgtctggatctagctggtcgggacctcactgactaccttatgaagatcctcactgagcgcgggtactcctttgtcaccaccgctgaacgtgaaattgtccgagacatcaaagaaaaactgtgttatgtcgccctggattttgagaatgagatggccaccgctgcatcttcctcctctctggagaagagctacgaacttcccgatggccaggtcatcaccattggcaacgagcgtttccgctgtcctgagactctcttccagccctctttcattggtatggagtctgccggcattcacgaaactacttataacagcatcatgaagtgtgacatcgatatccgcaaagacctgtacgccaacaatgtcctgtctggaggcaccaccatgtaccctgggattgctgatcgtatgcaaaaggaaataactgcactggctcccagcaccatgaagattaagattattgctccccctgagcgtaaatactctgtctggattgggggctccatcctggcctctctgtctaccttccaacaaatgtggatcagcaagcaagagtacgatgaggccgggccctccattgtccaccgcaagtgcttctgaggcggctaccttacactcaggacgacagtattgtgcttggaatcctctgaggccctctcccatctcccatcagtcattgtacagtttgtttacacacgtgcagtttgtttgtgcttcaaatatttattgctttataaataaaccagaccaggacttgcaacc

SEQ ID NO: 4466 - DNA, 1536 bp, Rattus norvegicus
  Genbank Accession No. X80778
agccaggttttccaatggaatgcaggcagaggcgagcttagtggtagaagaagcatggcgtggagacagctgagaaagcgggccctggatgcagtcatcatccttggaggtggaggacttctcttcacctcttacctgacggccacaggggatgaccatttctatgctgagtacctgatgccaggtctgcagaggctgcttgatccagagtcagcccaccggctagctgttcgagtcacctccctggggctccttcctcgagctacatttcaggactccgacatgctggaagtgaaagtcctgggccataaattccgaaatccagtaggaattgctgcaggatttgacaagaacggcgaagctgtggacggactctacaagctgggctttggtttcgttgaggtaggaagtgtcactccccagcctcaggaaggaaaccccaggcctagagtattccgtctccccgaggaccaagctgtcattaacaggtatggattcaacagccatgggctctcggtggtggaacacaggctacgggccagacagcagaagcaggcccagctcactgcagatgggctgcctcttggaataaacctggggaagaataagacttcggaggatgctgctgcagactatgcagagggtgttcgaaccctgggccccttggctgactacctggtggtaaacgtgtccagccccaacactgctggtctgaggagcctacaggggaagaccgaactgcgccacctgctgtccaaggtgctgcaggagagggacgccttgaagggcacacggaagccagcagtgctggtgaagattgcccctgacctcacggcccaggacaaggaggacattgccagcgtggcgagagagctgggcatcgatggactgattgtcacaaacaccacagtgagtcgccctgttggtctccagggtgctctgcgctctgagacaggaggactgagtgggaagccactccgagatctgtcgactcagaccatccgggagatgtacgcccttacccaaggcaggattcccattatcggggttggtggtgtgagcagcggacaggacgccttggagaagatccaggcaggggcctccctggtgcagctctacacagccctcatcttcctgggaccaccagtcgtggtcagggtcaagcgtgaactagaggcccttctaaaagagcggggttttaccacagttacagatgccattggagcagatcatcggaggtgaccatacgtgccagaagtcccatccagattgtgccttccaactcaggtgagctgtgtgactgcaccgtgaggaagagccgtctcaatccatgtcccttgaactgatggcctggacggactgcacaggccagtcgtgggcatcacatgccagtgaagaacttctctaaccacttgaggagaccacaaatcccactgtcactccctagatctaaatcctgggattgatcagtatcagaaggacattggcttcttgggaggaaaaatcgtggagaaaataaagccatgtaaacctgta

SEQ ID NO: 4467 - DNA, 443 bp, Rattus norvegicus
  Genbank Accession No. X81448
caagatcatcgaagacctgagggctcagatctttgcgaattctgtggacaatgcccgcatcgtcttgcagatcgacaatgcccgtcttgccgctgatgactttagagtcaagtatgagacggaactggccatgcgccagtctgtggagagtgacattcatggactccgcaaggtggtggatgacaccaacatcacgaggttgcagctggagacagaaatcgaagcgctcaaggaggagctgctgttcatgaagaagaatcatgaggaggaagtccaaggcctggaagctcagattgccagttctgggttgactgtggaagtggatgctcccaaatctcaggacctcagcaagatcatggcggacatccgtgcccagtatgaacagctggctcagaagaaccgtgaggaactggacaagtactggtctcagcagattgaggaga

SEQ ID NO: 4468 - DNA, 989 bp, Rattus norvegicus
  Genbank Accession No. X83579
gagcgaaccgtaatgagaaactggacttcctcggagagggacagtttgctactgtctataaggccagagataagaacaccaaccagatcgtcgccattaagaaaatcaaacttggacacaggtcagaagctaaagatggtataaatagaacagccttaagggagataaagctcttgcaggaactaagtcatccaaatataattggtctccttgatgcatttggacataaatcgaacattagccttgtctttgattttatggagactgacctagaggttatcataaaggataacagtctcgtgttgaccccatcccacattaaagcctacatgctgatgactcttcagggcttggaatatttacatcagcactggattctacacagggatctgaaaccaaacaacttgttgttagatgagaatggagttctgaaactggcagattttggcctggccaaatcatttgggagccccaattgggcttacacacatcaagttgtgaccaggtggtaccgggcccccgagttactgtttggagctaggatgtacggtgtgggagtggacatgtgggctgtcggttgtatcttagcagaattgcttctaagggttccttttttgcctggagattcagaccttgatcagctaacaagaatatttgaaactctgggtacaccaaccgaagaacagtggcctgacatgtgtagtcttccagattacgtgacgttcaagagtttccctggcatccccctgcagcacatcttcattgcagctggagacgacctgcttgagctcatacaaggcttgttcttattcaacccatgtactagaattacagcttcacaggcgttgaggaccaagtacttcagtaatcgtccagggccaacacctggatgccagcttccaagaccaaactgtccagtggaagcattaaaggaacagtgaaatccagccatggcgacaaaacggaaaagagcggaggccttagaacaa

SEQ ID NO: 4469 - DNA, 472 bp, Rattus norvegicus
  Genbank Accession No. X89695
tatctgcaaccctctccgctacccagtgctcatgagcggccgggtgtgcctgctcatggtcgtggcctcctggttgggaggatccctcaacgcctccattcagacttctctgacccttcagttcccctactgtggatcacggaagatctcccacttcttctgtgaggtgccctcgctgctgatgctggcctgtgcagacactgaagcctatgagcaggtactatttgtgacaggcgtggtggtcctcctggtgcccattacattcattactgcctcttatgccctcatcctggctgctgtgctccgaatgcactctgcggaggggcgtcagaaggccctagccacatgctcctctcacctgacagtcgtcaatctcttctatgggccccttgtctacacctacatgttacctgcttcctatcactcaccaggccaagacgacgtagtatccgtcttttacaccgttctcaca

SEQ ID NO: 4470 - DNA, 430 bp, Rattus norvegicus
  Genbank Accession No. X89698
tatctgcaaacctctttactatacaactattatgagtaggcccatatgtcaccgcctggtggctggttcctgggtggggggattttttcattctattattcagattttcatcactatccctttgcctttctgtggtcccaatattattgaccactacttctgtgacctccatcccttattcaagttggcctgcactgacacttttgtggtaggggtaattatgtttgttaacagtggattattttctgtattttccttccttttcttggtgtcttcttacattgttatcctatataacttgaggaatcactctgctgaggggaggcgcaaggctctatctacctgtgcatctcacatcatggtggttgtcttgttcttcggacctgccatcttcctctacttgagacctgcttccacctacactgaagac

SEQ ID NO: 4471 - DNA, 472 bp, Rattus norvegicus
  Genbank Accession No. X89700
cattagcaacccgctgaggtactctgtaatcatgagccgccgtgtctgctggctcatggtagcggggtcttggctctttggcctggtagatggactgatccaggctgtttttacgcttcgcttcccctactgcagttcccaggagatcgaccacttcttctgtgaggttcctgctgtgctcaagctggcctgtgctgacacctccctctatgagaccatgatctatgtttgctgtgtcctcatgcttctcctgcccttttctgtcatctcggcctcctacctccggatcctggtggcagtgctccggatgcgctctgcagaaggtcggcagaaggccttcgctacctgttcctcccacatgattgtggtctccctcttctacggggccgccatgatcacatacatgcgaccacaggcctaccattcctccaagcaggacaaagtggtctctgccttctacaccatgatcacc

SEQ ID NO: 4472 - DNA, 466 bp, Rattus norvegicus
  Genbank Accession No. X89702
aatatgctacccacttcgctactcaataattatgagccacagagtatgtgccatcctggccacagggacatcattttttggctgcattcaggccacttttctaactactctcaccttccagttgccctactgtggtccaatgaggtgggactactacttctgtgatatccctgtgatgctaaagctggcttgtgaagacacatcagccctggagatggtggggttcatcagtgtgggcctgatgcccctcagttgtttcctcctcatcctcacctcctacagctgcatcgtctgctctattctgcagatccgctctgctgagggccgtcgtagagccttctccacctgcagtgcccacctcactgccatcttgcttttctacatgcctgttgtcctcatatacttaaggccaactcctagcccttggctggatgcaactgtgcaggttttaaataatttggttact

SEQ ID NO: 4473 - DNA, 2492 bp, Rattus norvegicus
  Genbank Accession No. X94551
ccgggcaggtgacaaagccgtggagatctatgccagtgtggcccagctgacccctgtggactcggaggctctagagagtgaagcaaataaaatcaagaaagaagctgcagatctggaccgtctgattgaccagaagctaaaagattacgaggaccttagggaagacatgcgaggaaaggaacatgaagtaaagaaccttctagagaaggggaaagccgaacagcagaccgctgaccaactcctagctcgagccgacgctgccaaggctcttgctgaagaagctgctaaaaagggacgcaataccttacaagaagctaacgacattctcaacaacctgaaagattttgatagacgagtgaacgataacaagacagctgctggaagaagctctaagcgaattcccgccatcaaccggaccatagctgaagccaatgagaagacaagggaggcacagctggcgctgggcaatgcagcagctgacgccacggaggccaagaacaaagcccacgaggcggagaggattgccagtggcgtgcagaagaatgccaccagtaccaaggcggatgcggagagaaccttctcggaagagacagacctggataacgaggtgaatggcatgttgaggcagctagaggaagcggagaatgagctgaagaggaagcaagatgatgccgaccaggacatgatgatggcgggaatggcttcacaggctgctcaggaagctgaacttaatgccagaaaagccaaaaactctgtcagcagcctcctcagccaactgaccgacctcttggagcagctgggacagctggacaccgtggacctgaacaagctcaacgagatcgaaggctctctgaacaaagccaaagacgaaatgaaggtgagcgacctggacaggaaggtgtccaacctggagaacgaggcccggaagcaggaggcagccatcttggactatgaccgagacatagcagagatcataaaggacattcacaacctggaggacatcaagaagacactaccaacaggctgctttaacaccccgtccatcgagaaaccctagtggtgggagggctgtaaggcagtgtccctgacagggggccctgtgaggcctcggtgccttgacagcgaaaaaattacacttttcagaccccccccacttctctgctgctctctgtcactgtccttttgacccaagaaaagtcagagtttaaagagaagcaagttaaacatccttaaccaggaacaaagggttttgcctaataaagtgtctcctccacttctgtcagcaccctaccggaactttcccttgtttgcctgaagtcatagcatcttccagtggcatacccacatcacgtgagcctttgtatgccagggcagacccagccccctcccctctctcaagcaccatcagaacctatcttagtactccatttttctatgaaggagatgttcagctcctcacgtatgcactgagatggccaatatgtccagtcgcatcttctgcctcctcttgaagcaaaggaaataaacatcctgtgccaaaggtattggtcattagacgttggtagccatccatcagacatgctggctgtttgagcataggccactgagccattacgggtaacagtgtagttacgtgtgggtctctgagagagcatggctcaaagatgcttacatttttctcctgtgctaattgactaggaagataaacgtttcccaatcctcagccgcctgatagagagtctggatgggcagcttgcacataccactacactaggtagcttttgatagttttataagcaggactcagtgcagaagaaacagagatgtgataaccactcacgttttttttcccccaaatcttactaattcttggagcttcgttagtgtgttagaattggaacttattgttagcatatctatcaaaacagtcgtcctctaaggtcttgaccaatgaaagaaaagcaaatctcctttccacccattttctgggaagtggatgtaaccggtatgattaggattccataagtgaatttctctttctctgttggagagagatgtgacatttggcccttagctccaagtctcttctgacatttacattctttcaaaacacatcattgttggccagatcctggtggcaaacgctgctctcagtgtttctcaaggccgtggaccccatctagttcctgcgctttgtcgtccgcccactctaagcctttcctctgtgtggggagggaagaaccatgcatggcgtttcctagtgggcttctcgacctctgatcctcagctctgtggttcccttaagaccacaccgggacagttccctgccacacgcccccttcctcctatctacctgcctctgagattcgtatttagcctttaacactatgcaattttgtactttgcgtagcggggggggaaagaaactattatctgacacactggtgctattaattatttgaaatttatatttttttgtgtgaatggatttt

SEQ ID NO: 4474 - DNA, 463 bp, Rattus norvegicus
  Genbank Accession No. X95850
tttaggcataaaggggtatgttaatccattgccacatacaattcctataattacatatagggagtgaactgtgaaccagttagaaacctgtatctagttgccaacgagtgccactggagaaaagaaactccacaagttgaagaactgagaaattagcttccttccagtgtgacgcggtacacggaggtgctctcgagcgagtgagcttcctcctttcgcaaacgctaatgcagtagtagcaatcaatcttgtcctctcttgtaaacatctgctggtggtccagagctctgagccagtcatgctgctgtctaggttctaacagctgtttgtggactcagttaccattgcaagtggacaccttacccgactagaaataaacattttccctgctctcctgatgccccgttccttctttctgcaaacacatcttaggagtaagactttaaacctttgatctcccaca

SEQ ID NO: 4475 - DNA, 1758 bp, Rattus norvegicus
  Genbank Accession No. X96437
gaatagcgtctcgggagtgtccctgggtaatcgctgcatctcgttttgtgtgtgtgctctgtcgaaacgtctgtgatgtgtgtatggttttcacgtgaacggaggcaggcagagttgggtctgtgggttctagtgtgttcttaatctttttggaagtttgtgcagtgacttcccctctgggattgtttcctatgcataccttcaagtatgtgtgaatgtgttttctgtggtcccttgatcttactgggcttctctaaggagggtggctggaccatctgctacgtgtctgggagcccctctctagctaccacatgtcccgacatgtgcttactcccaatatttgcacccactcgcattcacaactcccaggcaaaaagaaaaaatcaaaaaaacaaaaaaaacgtgcactggggcacctagaaaatgggcagccaaggctccgcctacattttgcttcctccttggaatttccagccctgtgcagccaactgctccctagctgcgaagggcggagtttcccggctctataagtagtggtgccttaccggggatccgcactcctccgtaccctctgtacagcgcgcgaattatgtgccattcgcgtaaccacctccacaccatgactggcctgagggctccggcgccagttccctccaccggcccggaactccggcggggctccggtcccggaattttcaccttcgaccccctcccggagcgggcggtagcgtccgccgtgcgtccgaacacttctcgcgggcacggaaaacgcagccgacgggtgctctaccctcgagtggtgagtatcgcccgagtgggcagcaagaggtcgagtcgccccggaacctttgggaacaactagatgcggggactttcgtctgacgtttccctcttttctctgctcaggtccggcgccagctaccaaccgaggaacccaacattgccaagaggatcctctttctcctgctcgccatcatcttctgccagattttgatggctgaagaaggtgtgtcgcaggccctggctccggaggatgctaccagcgccatatcacctgagcccatctctgcgcccattactgcgcctcctgtcctcgagcctttgaacctgacctcggagtcctcggactatgctctggatctcaaagcttttctccagcaacacccggcggcattctaaacgcgatgggtcacagtccggaaaaaaaaacccaaagagcaccaggggtacctggtcggcaagaacgtatcccaaactgggacttataaggcaacgctaactcagaacactaccgccaagatgccggttcttggggcgagcccgaggcaccgtgggtcctggctaggctcactggtgacggacggaggtcttctccgtgtctaattaatatttatgtatttatgtatatcctcctaggtgaaggaggggtgtatgtaatatttattctaacttatgcaggggtgcgagatatgcccccttgctgtgacacagatatttattacgatttatagggtccgtgagacagagttgtgggaggattagtttagtcttggtcggggggcataggtttaggggtaacactccattttccagcacttcgactctgttgtaagactttggcagacccttgggaatacggtctgtgtgcctttgatgtcttcctgactggaagtcttgggtccatggattgtcagagggcggctgtctggggtcgcctagtatgttctgtgaacacgaataaacttgatttgcctgtcg

SEQ ID NO: 4476 - DNA, 557 bp, Rattus norvegicus
  Genbank Accession No. X97374
gcaggacccaggccactgactccctctacaaactcttccttcccaggtgaacctcagacctgggaatcacctcagggaggaatggtgcttggccctttgtgttgtggtccccacagctgactaaccctctccccagaccgtactgactggcatgtgccccttatgtgtttcagcctcttgcttcccacggctgcaccatgaaaatcctgttttgtgatgtcctgctgctcagcctgctctccagcgtgttcagcagctgtcccgaggactgcctcacctgccaggagaggctccacccggctccgggcagcttcaacctgaaggtaggtccaggaggtggagggactgccctcttccctgacatctcttccctctgactccaaggcaaaccctacgaggtcctctggcttaagcagtatcatctgaccaagaggaaacaggtggatctgagctacatcttcctaccatgaccctgtggtcctccctctttattaccagattccagagatcctccctctctgccaccagactcctctggttctccctctctatctccc

SEQ ID NO: 4477 - DNA, 416 bp, Rattus norvegicus
  Genbank Accession No. X99723
cacgaggagcaggatgaggaggaagatgaggtgcctgatgatgagaccgtcaaccagatgattgcccggcacgaagaagaatttgacctcttcatgcgcatggacttggaccgccggcgtgaagaagcccgcaaccccaagcggaagccacgcctgatggaagaggatgagcttccatcctggatcatcaaggatgatgcagaggtagagcggctgacatgtgaagaggaagaggaaaagatgttcggccgtggttctcgccaccgcaaggaggtagactacagcgactcactgacagagaagcagtggctcaaggctatcgaggagggcacgctggaggagatcgaagaggaggtccggcagaagaaatcttcacgtaagcgtaagcgagacagcgaggccggctcctccacccc

SEQ ID NO: 4478 - DNA, 1900 bp, Rattus norvegicus
  Genbank Accession No. Y07534
tgcctggatggggcgcgtagtctctggctctaaactcttggcttctcagacacgatctatggctgtgttgagccgcatgagactgagatgggcgcttctggacactcgtgtgatgggccatggcctctgcccacaaggggccagagccaaggccgcgatccctgcagccctccgggatcacgagagcacggagggtccaggaacaggtcaagaccgaccgcgcctgcggagtctggcggagcttccgggacccggaacgctacgctttttattccagctatttctacgaggctatgtgctgcacttgcacgagctccaggcgctgaacaaggccaagtacggcccaatgtggacaaccacctttgggactcgcaccaatgtgaatctggctagcgccccgctcttggagcaagtgatgagacaggagggcaagtaccccataagagacagcatggagcagtggaaggagcaccgagaccacaaaggcctctcctatgggatcttcatcacacaaggacagcagtggtaccatctgcgtcatagtttgaatcagcggatgctgaagcctgctgaggcagccctctacacagatgccttaaacgaggtcatcagtgactttattgcccggctggaccaggtgcggacagagagtgcatcaggggatcaggtgccagatgtggcacatcttctctaccaccttgccttggaagccatctgctatatcctgtttgagaaaagggttggctgcctggagccctccatccctgaggacaccgccaccttcatcagatctgttggactcatgttcaagaactcagtctatgtcactttccttcccaagtggtctcggcctctgctgcccttttggaagcgatacatgaataactgggataacattttctccttcggggagaagatgattcatcaaaaagtccaggagatagaagcccagctacaggcggctgggccagatggggtccaggtatctggctacctgcacttcctgctgactaaggaattgctcagtcctcaagagactgtcggcacctttcctgagctgatcttggctggggtagacacgacatccaatacactgacctgggccctgtatcacctttcaaagaacccagagatccaggaagccttgcacaaggaagtgactggtgtggtacccttcgggaaggtgccccagaacaaggactttgcccacatgcccctgctaaaagctgtgattaaggagaccctgcgcctctaccctgtggttcccacaaactcccggatcatcacagaaaaggaaactgaaattaatggcttcctcttccctaagaatacacagtttgtgttatgccactacgtggtgtcccgagatcccagtgtctttcctgagcccgagagcttccagcctcaccgatggctgaggaagagagaggacgataactccgggatccaacacccatttggctctgtgccctttggctatggggttcggtcctgcctgggtcgcaggattgcagaactggagatgcaactcctgctgtcaaggctgatacaaaagtatgaggtggtcctgtctcccgggatgggagaagtgaagtctgtgtcccgcatcgtcctggttcccagcaagaaggtgagcctacgctttctgcagagacagtagtaccaagctgggctcctgctccatgggacttgtccagaagccctggcacagaagttcttggccagtctcacgtcacatgtcacgatgccagattcaacaggggacctctctgcccttcccatagacaccagacgtctggcacaatctctactgagcagcacccatttaagacattagagcacctcatatcacaggacggtgcttgggtacaatttaaaataaaatttaaaattcaaaaaa

SEQ ID NO: 4479 - DNA, 1662 bp, Rattus norvegicus
  Genbank Accession No. Y08355
cattcagtttagtcagaatccatgggtgggctcagctgtctcctccgtacctagtctgcggttatggcttcgctcacggtgaaggcctatctactgggcaaggaggaggcggcccgcgagatccgccgcttcagcttctgcttcagcccggagccggaggcggaagccgcggctggcccggggccctgcgagaggctgctgagccgggtggctgtgctgttccccgcgctgcggcctggaggctttcaggcgcactaccgcgatgaggatggggacttggtcgccttctccagtgatgaggaactgacaatggccatgtcctatgtgaaagatgacatcttccgcatctacattaaagagaagaaggagtgccggcgggaacatcgccccccatgtgctcaggaggcacgaagcatggtgcaccccaacgtgatttgtgatggttgcaatgggcctgtggtgggaactcgctataagtgcagtgtgtgccccgactacgacctgtgcagcgtctgcgaggggaagggcctgcacagggagcacagcaagctcatctttcccaacccctttggccacctctctgatagcttctctcatagccgctggcttcggaagctgaaacatgggcactttggctggcctggctgggagatgggcccaccagggaactggagcccacgtcctcctcgcgcaggggatggtcgcccttgccccacagctgagtcggcttctgctccatcagaggatcccaatgtcaatttcctgaagaatgtgggggagagcgtggcagctgccctcagccctctaggcatcgaggttgacattgatgtggaacatggagggaagagaagccgcctgacacccacctctgcagaaagttccagcacaggcacagaagataagagtggtactcagccaagcagctgctcttcggaagtcagcaaacctgacggggccggggagggccctgctcagtctctgacagagcagatgaagaagatagccttggagtcggtgggacagccagaggaactgatggagtcggataactgctcaggaggggatgacgactggacgcatttgtcttctaaagaagtggacccatccacaggtgaactccagtctctacagatgccagaatcggaagggccaagctctctagacccctcacaggaaggccccacagggctgaaggaagctgccctgtacccacatctcccaccagaggctgatccccggctgattgagtcactctctcagatgctgtccatgggtttctcggatgaaggcggctggctcaccaggctcctacagaccaagaattatgacatcggggctgctctggacacgatccagtattcaaagcaccctccaccattgtgacagtgctgtggccaagtcccacaacccacctcccttgtcttctagttgcatcatgtagagtagcagggcttctaaggcccagtgtcttggcattcttctagaaccttcaggtgggactgtgaggccttcttaggcagtaggaaagtgcatgagaagagagtctgagtgtgcacatgctgacccctgagcacagatccaagcagctgtggctgggcttmcgctgctttccctcggcctggcctttgccagggagctgtggagtcatgctgcactccactt

SEQ ID NO: 4480 - DNA, 3582 bp, Rattus norvegicus
  Genbank Accession No. Y09000
gttattctccgaggggcccgacagcccccgggagctccaggatgaggagtccggcagctgcctctgggtgcagaagtccaagctgttggtgattgaagtgaagactatttcctgtcattatagccgtcgcgctgcttctcgacagtccatggacatccaggccagctactgggcccgtgggccccagaaccgcacgtgtaggctgcgccccggatcccctgagccgccaccccgccgaccctgggcctccagggtgctgcaggaggcgaccaactggcgggcagggccccccgccgaggtccgagcccgagaacaggagaaaagaaaggcggcgtcgcaggagcgggaggccaaggagaccgagagaaaaaggcgcaaggctggcggggcccgacggagtcccctaggtcagccccgcccagagctccggaacgcccttcgggcggcccaacctacagggtttccagttttctccagaccagagcgcttcgggcaggtggggcgagcgccccgaccatccgcgctcccgcagggtgacccaggggttgcatgggcggggccatggggaggcagaaggccagggcctcctagctacgaggctcacctgctgctgagaggcgctgcaggcacagccccaagacgccgctgggaccggccgccaccctacgtggctccaccttcttatgaaggtccccacaggaccctggggactaagcgaggcccggagctctcccgggcgcccacctcatcagccccagtgccagctaccaccaggacagagggagggcgcacgaagaagaggctggatcctcgaatctaccgggatgttctaggagcttggggtctcagacagggacggggactcttaggaggagctccaggctgtgcagcagccagagctaggccagagtcttgcaaaggggctgtagagaaaagttcaggcctagctgctgctggcctaaacagtggtggtgatggtcattcccaagccaaaactactggtccagtcacggaggtcgctctctctgggtccacgatcagtagcccaccacgtcctgttcccaggtctaggcagcacctcaggggatcaaggaaagggaaagaaggaagtgaggagatgtggcttcccacgtgttggctttcctcccctaaaaagcctccagttaggcatagccagaccctccccagaccctgggctcctggaggcaccgggtggaaagagtccctgggtcaaagagaggggacagagcatgagaccctggaagtctggaaggtgacccgccgtgcccacaccctgccccgcagttcccgaggtcccgctggtagagaaggcatctttgtcattgatgccacatgcgtggtgataaagtcccagtacgttccaacccctcgaacccagcagaggcagctcgcgccctctggggagtcatgcatcgtgagcgacagcctcaggcaacccaaaccctgccttgaggaggagggcaaaggggccgctgccaacccttcagtttgccaaaagcgactgttgagcagtcgagtcttaaacccaccgagtgagggtcgcgagttcgaggctgagggcagacagcagggggattcttcattggaggagcgctcctccagcggtttggggttccctgtcggcgaagtgaacccgcgagatgcccccacgcatccaggtagcccagagcactcgaccttaggcccagcggctccgggatgcgcgggcagcgtgaagggcccagaagcagctggggtcccgcggcgcgcgggcgggggctgggcgcggactccagggccctacgccggagccttgcgggaagccgtgtcccgcatccgccgccacaccgccccagattcggactcagacgaagccgaggatctcagcgcccatagtggctcctctgatggaagcgacacagacgccccaggcgcctcctggcggaatgagaggaccctgcctgcggttgggaacacccggcccagggaaggcgggaagacagctgagctgggcgacagtatcggggagattctagatgtcatcagtcaaaccgaggaaggcctcgtccgagaggacaccaggaaaacgccacagggaaagagagagtgagagtgagcgacgcccctccttgtcctcgtgtcgctcggcccagccagccttgggctcaccgcgctcctttcctctctccaggcttcgtttgcttccttttcttctttcctacctgtacctgttcccttgagacagaggagaggggaggaacgagggaactgactcaagagtcagtttcagggaaagagagggtgggatcccacacctgctacattcggtgtggaactgttcagagaggcaaagtgaagggcagggcagggtccctggcaggagaggaaaagtaacggagaggcttttgaacctagtgacctagtgcaggagacagagggcttttagcagagaagaaatgaatgcagaatgcatacactcaaccagcaaattggcaagagggctctcctagatgttacaactcaagtttcaattccaactctgccactgacttagctggtggatctcagagtgactacttttctgcccgggcatcagggactaatgtaaatgtaaaacgagcgatttctgcctcccattcttttgtccctagaattttgtgaacgagcgagtagaatttgagggttcttacccacttctgccatcctcagttcggaagacagtcagggttttcagatttaaacgggcaaagggcttctattccaatttcccgagtttaggtgaatgctccccaaagcagggcaagataaaggtccggtccactgcctctggcctgctgtgatccaagctggagagggaaggtagccaatgaatcagcttggaacacttttaggcctgcccctttcctccatctccgtgtccttagtgatgctctacgtgttaccggacggcagacggtatggcccaccggatagaccctgactatctctgtgtctctcctggaaaacagccaggcaaggaggaaggttgatcacagcagacggtgtgggtgtgatactcgctgtagccactacggggcgcgcgcaggtcgcggattcccccccggttgctggtgctcgagtgcccctacaccagcactgccagttatctggatcccttatttcccggcgccggtttcccgccttgacacctccaaaccgcgcgcggggccgggagcaggcctccggtctcccagacttctggggcgcgccgagcccttctttgtattaatccacgcctaccggtttgagactgacattcaagtcttttttttttttttctttccttttcctttttctgttttcttttccttctttccaaaccctggggcacttcctgtgtgtctgccacttactagccatgtgaccttggccaaatcacttcacctccctgagcctcagtttcctcatctgttcaaatgggggtttataaacacctacctcgcagggttgttgtgaggatttaatgaggtaatgtatataaagcgtcttgcacagtgcctggcacatagtaggcgcccaataaatctactcgtccctttaaaa

SEQ ID NO: 4481 - DNA, 1644 bp, Rattus norvegicus
  Genbank Accession No. Z11995
gcactacaaagagaagatccacgagtacaatgtactgctagatacactgagcagagctgaagaaggttatgagaaccttctcagcccctctgacatgacccacatcaagagtgacaccctggccagcaagcacagtgaactgaaggacagactgcgtagtatcaaccagggcctagaccgcctgaggaaggtcagccaccagggctacggccccgccactgagtttgaagagccccgagtgatagatctgtgggacctggctcagtctgccaacttcactgagaaggaactggagtcgttcagggaggagcttaagcacttcgaggccaaaatcgaaaagcacaaccactaccagaagcagctggagatttcccaccagaagctgaagcacgtggagagcatcggtgaccccgagcacatcagccgcaacaaggagaagtacgtcctgctggaggagaagacaaaggagctgggctacaaggtgaagaagcatctgcaggacctgtccagcagggtctcaagggctcggcacaatgagctctgagaccagaagccactggcagtagcctagagaggctcttgaagacactgggaactgtcaacttgtcatactggtgtggctgtccacagtggcaaggagaaataccgatctgatcctgctgcggctggcaaggactaattttctttcaagcaagtgtagctgtcaccgccctggttgagggctttgggtacatctaccaatgagatatgaccggtctccatgctgcagcaaaagtttacattgaaattatataaatctgtcgccgacagtttattgaaaggaaatcttgctttatccatgaagtcacttccatggaggtagctgtgataaagtgtctcttccccatgacaacgcatagcaccaatccctactgaaagacctgcccgagtacaccaactgtcctggtggaatgacactctggagcaggaaaaacaaatttctaaaaggcatacagtgattatcttctgagctttgcagctggcaacatgtatgttttcacacaagatatttttaagctagcgaaagaaaatactcaagcaggattagttcttaaagcaataaacaggggaataaaaacatcatgtatatataagaaaaccaaggcatgctcacaggtttgagccaagaaagacctggagccctaatccccaccttgtcccaggatgcacctgtcatgatcacagggaagagatgagtctgggatttacaaacctctctctaaacctcagtccagtgttgtgccgctggctgtaccacacacaccgcacaagccccgactgctcccattccattacggcacaggagacatgttctcaccctgcctagcctgctttggtggggggaggcggcggcagggaactctacaagtgtttccagtggtgacctctgttctccctttcaggagctgttttccttcatgtagctagccccatggctaccagaaagaactagaataggagctggctgattttgtcaaaccccaaaacaaacacccctttcctccgggtcttgattttgtcacctgaatctctgggacgagtggccaaggcatttctaggcttactgcaagtatcagatgacgacataagattctagaagtcaag

SEQ ID NO: 4482 - DNA, 2854 bp, Rattus norvegicus
  Genbank Accession No. Z12158
atcgctcctttttgagtgcctgggtgccgcggctgccgcgtcagtctgctgcgctccatgaggaagatgcttgccgctgtgtcccacgtgttggcaggcgctgcgcagaagccggcaagcagagtgctggtagcttcccgtaatttcgcaaatgatgctacatttgagattaagaaatgtgaccttcatcgtctagaagagggccctccagtcaccacagtgctcaccagagaggatgggctcaagtactacaggatgatgcagaccgtgcgccggatggagctcaaggcggatcagctgtataagcagaaaattattcgtggtttctgtcacttgtgtgatggtcaggaagcctgctgtgtgggcctggaggctggcataaaccccacggaccatctcatcactgcctatcgagcccatggcttcaccttcactcggggcctgcctgtccgagcaattcttgcagaattaacaggacgaagaggaggctgtgctaaggggaaaggcggatcaatgcacatgtacgccaagaacttctatggcggcaacggtatcgttggagctcaggtgcccctgggtgcaggaattgctctggcctgcaagtataatggcaaagatgaggtctgtttgacattatatggtgatggtgctgctaaccagggtcagatatttgaagcttacaatatggcagcattgtggaaattaccttgtattttcatctgtgagaataaccgctatggcatgggcacatctgttgagagagcagcagccagcacggattactacaaaagaggagatttcattcctggactgagggtagatggaatggatatcttgtgtgtccgagaggcaacaaagtttgcagctgcctactgcaggtctggtaaggggcctatcctgatggagctacagacttaccgctaccatggacatagtatgagtgaccctggagtcagttatcgcactcgagaagaaatccaggaagtaagaagtaagagtgaccctattatgcttctcaaggatagaatggtgaacagcaatcttgcaagtgttgaagaattaaaggagattgatgtggaagtgaggaaagaaatcgaggatgctgcccagtttgccacggctgatccggagccgccattggaggagctaggctatcatatctacagcagtgacccacccttcgaagtgcgtggtgccaaccagtggatcaagtttaagtcagtcagttaatgggagagtattagatggatgggcgtttctcatccgttgtaagaaactctttgtgctctcaactttgacaggaaatacccagacaacaaaagtcttgaaaacatgtaaattaagggagagtaaaattgcatgcagtttgtacattgttgtattcggtgtattcatgtgaataagagtgtataggattggagatgggtaatgcagtttataaccttcatcatgtcctaggtcagttactaaaaggaacaactctgccatttggtgatgtgatcatagctttgaatgaccttgtggaggcatgctgggattaatgcaaagcacaggttagaagtgtatggtcaccatgaattgtggaggctggactctgtttggcactgaccgttatgtctttgatcaaaggctatatataatcatgtgttttaaaataagggtacttcagtcacttcaaaggtaaaataatttaattttctccatttagacatttaacaaacacaaaattgtactcccattccaaggcacactttttaacttttcacatttaagtaattacactggtttataaaatacttaggctttatctttccagcaactgctataaggtatgctgacattttaaatactaggtcaggagagacattacttacaatccggtttataaacaagtatgctctaaatcacatgtgcttgaatgaaacgaacaagggtctttctgtgtaaacgcaggatttgtgtgtgcactaacagaagctttaatcgtgagcaggtgtagggtactttttgctcattctccccagcttggcttattgtgaggactcctgcatttgtcttctgtgctgggagactgcatgccagagcctacagaggacaccaccactgcaaaacaataattttcataagaaaagcaaacttgaagccacccatctactcttcaaatgtaatctctaacttaaaagtatgtaaccttttcctagacatggtaccataggaacactgggtgatctgggtagaggtgtgggcatttaaacaatgtaaagaaaggtctggcacctcatgccttgccaacctgagaaaatgagctgtgcttgctacaacataggaaagataaatttcaaagatcggggaaactaccagcattaaaaataaaagtattcacataaaaaagccccattttattatttaaattgtttgcaggctctcttaccgtagtctgaggcaccttaggtcttccttagtgatatcattgagaatatcagaaagtgtgtaatcttcttcaacaatctgaaagattcaacatacattcaacaacataagcagcttttcaacagtatcataggaatcctttgatttagaaatttaccttttctattgtatttgcatccactccttgtagctgcaaccagtctataagctctctgttggttcccagtccgtcatggggtggtgggttctctgttccacctataaagattccaattttgttttattgtatagtaatgtataaccataaaatgcttcaaaaataacaaagtggatgtaatcatgtatccaaacagaaatgtaaatgtgctgtgaaaaggaaatgaattaaacttgtttgacccgctaaaaaaaaaaaaaaaaaaaa

SEQ ID NO: 4483 - DNA, 2407 bp, Rattus norvegicus
  Genbank Accession No. Z48444
ggtcctgagctcctgaggaaaaagcgcacaactctgcctgagagaaatacttgtcagctctatatccagacagatcacctgttctttaaatcctatggaacacgagaagctgtgattgctcagatatccagtcatgttaaagcaattgatgcaatttaccagactacagacttctccggaatccgtaacatcagctttatggtgaaacgcataagaatcaatacaacatctgatgaaaaagatcctacaaatcctttcaggttcccaaatattggtgtggagaagttcctggagttgaattctgagcagaatcatgatgactactgcttggcctatgtcttcacggaccgggattttgatgatggtgttcttggtctggcatgggttggagcaccttcaggaagctctggaggaatatgtgagaaatccaagttgtattcagatggcaagaagaagtcattgaacacgggcatcattactgttcagaactatggctctcacgtgcctcccaaagtctctcatattacttttgctcatgaagttggacataactttggatctccacatgattctggaacagagtgcactccaggagagtctaagaacttaggccaaaaagaaaatggcaattacatcatgtatgcgagagcaacgtctggggacaaacttaacaacaacaaattttcactctgcagcattaggaacataagccaagtgcttgagaagaagaggaacaactgttttgttgaatctggccagcctatctgtggaaatgggatggtggagcaaggggaagagtgtgactgtggctacagtgaccaatgcaaagatgagtgctgcttcgatgcaaaccagccagaggggaagaaatgcaagctgaagcctgggaagcagtgcagtccaagtcaaggaccctgctgtacagcacagtgtgcattcaagtcaaagtctgagaaatgtcgggatgattctgactgtgcaaaggaagggatttgcaatggcttcacagccctttgcccagcatctgatcccaagcccaactttacagactgtaacaggcatacacaagtgtgcattaatgggcaatgtgcaggttctatctgtgagaagtatgacttggaggagtgcacctgtgccagctctgatggcaaagatgataaggaattatgtcatgtttgctgcatgaagaaaatggccccatcaacttgtgccagtacaggctctttgcagtggaacaagcagttcactggtcggactatcactctgcagccaggctctccatgtaatgacttcagaggctactgtgatgttttcatgcggtgcagattagtagatgctgatggccctctagctaggctgaaaaaagcaatttttagtccacaactctatgaaaacattgctgagtggattgtggctcactggtgggcagtactgcttatgggaattgccctgatcatgctaatggctggatttatcaagatttgcagtgttcacactccaagtagtaatccaaagttgcctcctcctaaaccacttccaggcactttaaagaggaggagaccgccacagcccattcagcagccccagcgtcagaggccccgggagagttatcaaatgggacacatgcgacgctgatgcagcttttgccttggttcttcctagtgcctacagtgggaaaacttcactccaaagagaaacctgttaagtcatcatctgcaaatgaaaccctcacagttaatagttgaagaaaaaatggcaagagatcatgtcctcagaccaggtggaattacctaaaatttaaagcctgaaaattccaatttttttgggggggtgggatggaaaaggaacccaattttcttatggacagatatttttaacctaatggcacaaagtcttagaatattattatgtgccctgtgttccctgttcttcgttgctgcattttcttcacttgcagacagacttggctctcgataaacttttatcacaaattgaaatatatttttttcaactgccaatctaggctgggaggctcgaccacctcaacattggatacatcacttgccaatgtacataccttgtaatatgcagacatgtatttcttacgtacactgtacttctctgtgcaatttgtaaacagaaattgcaatatggatgtttctttgtataataaatttttccgctcttaatgaaaaattactgtttaattgacatactcaggataacagagaatggtggtgtgcagtggtccaggattctgtaatgcttcatgcaggccattttgaaatgagaattgaaaaccctttttcttatggtggagttggttcttacatgcatccttttcctgttccatggcttctgtgagtaggagaggctgtgttgaagagctcagctggtggcttacccg

SEQ ID NO: 4484 - DNA, 5721 bp, Rattus norvegicus
  Genbank Accession No. Z78279
atgttcagctttgtggacctccggctcctgctcctcttaggggccactgccctcctgacgcatggccaagaagacatccctgaagtcagctgcatacacaatggcctaagggtccctaatggtgagacgtggaaacctgatgtatgcttgatctgtatctgccacaatggcacggctgtgtgcgatggcgtgctatgcaaagaagacttggactgtcccaacccccaaaaacgggagggcgagtgctgtcctttctgcccagaagaatatgtatcaccagacgcagaagtcataggagtcgagggacccaagggagaccctggcccccaaggcccaaggggacctgttggcccccctggacaagatggcatccctggacagcctggacttcctggtcctcctggtccccccggcccccccggaccccttggtcttggaggaaactttgcttcccagatgtcctatggctatgatgagaaatcagctggagtttccgtgcctggccccatgggtccttctggtcctcgtggtctccctggcccccctggtgcacctggtcctcaaggtttccaaggcccccctggtgaacctggcgagcctggcggttcaggtccaatgggtcccccaggtccccctggccctcctggcaagaacggagatgatggggaagctggtaagcctggccgccctggtgagcgtggacctcctggacctcagggtgctcgtggattgcctggaacagctggcctccccggaatgaagggacacagaggtttcagtggtttggatggtgccaaaggagatactggtcctgctggtcctaagggagagcctggcagtcctggtgaaaatggaactcccggccagatgggtccccgaggtctgcctggtgagagaggtcgccctggaccccctggcactgctggtgctcgtggtaacgatggtgctgtcggtgcagctgggccccccggtcccaccggccctactggccctcctggcttccctggtgcagctggtgctaagggtgaagctggtccccagggagcccgaggctctgaaggtccccagggtgtgcgtggtgagcccggaccccctggccctgctggtgctgctggtcctgctggaaaccctggtgctgatggacaacctggtgctaaaggtgccaatggtgctcctggtattgctggtgctcctggcttccctggtgcccgaggcccctctggacctcagggccccagcggcgctcctggtcccaagggaaccagtggtgaacctggtgcccctggcaacaaaggagacactggtgccaaaggagaacccggccctgctggagttcaaggtccccctggccctgctggagaagaaggaaaacgaggagcccgtggtgagcctggacctagcggcctgcccggacctcctggcgagcgcggtggacctggtagccgtggtttccctggtgctgatggtgttgctggccccaagggtccttctggtgaacgtggttctcctggccctgctggtcccaaaggttctcctggtgaagctggtcgccctggtgaagctggtctccctggtgccaagggtctcactggcagtcctggcagccctggtcctgatggcaaaaccggcccccctggtcccgctggtcaagatggtcgccctggacccgcaggtcctcctggagcccgtggacaggctggtgtgatgggattccctggacctaagggtactgctggagaacctggaaaggctggagagcgaggtgtccccggaccccctggcgctgttggtcccgctggcaaagatggcgaagctggagctcaaggagcccccggccctgctggtcctgctggtgagagaggtgaacaaggtcccgctggctcccctggattccagggtcttcctggtcccgctggtcctcctggtgaagcaggcaagcctggtgaacagggtgttcctggagaccttggtgcccctggaccctctggcgcaagaggcgagagaggtttccctggtgaacgtggtgtacaaggtcccccaggtcctgctggtccccgaggaaacaatggtgcccccggcaacgatggtgccaagggtgatactggtgcccccggagctcctggtagccagggtgcccccggtcttcagggaatgcctggtgaacgtggtgcagctggtcttccaggtcctaagggtgacagaggtgatgctggtcccaaaggtgctgatggttctcctggcaaagatggcgtccgtggtctgactggtcccattggtcctcctggccctgctggtgcccctggtgacaagggtgaagctggtcccagtggtcctgctggccccaccggagcccgtggtgcccccggagaccgtggtgaggctggtccccctggtcctgctggcttcgctggcccccctggtgctgatggccaacctggtgcgaaaggtgaacctggtgatactggtgtgaaaggtgacgctggtcctcctggccctgctggtcccgctggaccccctggccccattggtaacgttggtgctcctggacccaaaggttctcgtggtgctgctggtccccctggtgctactggtttccctggtgctgctggtcgtgttggtccccctggtccctctggaaatgctggaccccctggccctcccggtcccgttggcaaagaagggggcaaaggtccccgtggtgagactggtcccgctggacgtcctggtgaagttggtcccccaggtccccctggccctgctggtgagaaaggatctcctggtgctgatggacctgctggctctcctggtacccctggacctcagggtattgctggacagcgtggtgtggtcggtcttcccggtcagagaggaaaaagaggcttccctggtcttcctggaccctctggtgaacccggcaaacaaggtccttctggagcaagtggtgaacgtggtccccctggccctatgggcccccctggattggctggcccccctggtgaatctggtcgtgagggatcccctggtgctgaaggctcccctggaagagatggtgctcctggtgccaagggtgaccgtggtgagactggccctgctggcccccctggtgctcctggtgctcctggtgctcccggccctgttggtcctgctggcaagaatggcgaccgtggtgagactggtcctgctggtcctgctggtcccattggccctgctggtgcccgtggtcctgctggaccccaaggcccccgtggtgacaagggtgagacaggcgaacaaggtgacagaggcataaagggtcatcgtggcttctctggtctccagggtcctcctggctctcctggctctcctggtgaacaaggcccctctggagcttctggtcctgcaggtccccggggtccccctggctctgctggttctcctggcaaagatggactcaacggtctccctggccccattggtccccctggtcctcgaggtcgcactggcgatagtggtcctgctggtccccccggacctcctggaccccctggccctcccggtcctcccagcggtggttatgacttcagcttcctgcctcagccacctcaagagaagtctcaagatggtggccgttactaccgggccgatgatgccaacgtggtccgtgaccgtgaccttgaggtggacactaccctcaagagcctgagccagcagattgagaacatccgcagccctgagggcagccgcaagaaccccgcccgcacatgccgtgacctcaagatgtgccactctgactggaagagcggagagtactggatcgaccctaaccaaggctgcaacctggatgccatcaaggtctactgcaacatggagacaggtcagacctgtgtgttccccactcagccctctgtgcctcagaagaactggtacatcagcccaaaccccaaggagaaaaagcatgtctggtttggagagagcatgaccgatggattccagttcgagtatggaagcgaaggttccgatcctgccgatgtcgctatccagctgaccttcctgcgcctgatgtccaccgaggcctcccagaacatcacctatcactgcaagaacagcgtagcctacatggaccaacagactggcaacctcaagaagtccctgctcctccagggctccaacgagatcgagctcaggggcgaaggcaacagtcgattcacctacagcacgcttgtggatggctgcacgagtcacaccggaacttggggcaagacagtcatcgaatacaaaaccaccaagacctcccgcctgcccatcatcgatgtggctcccttggacattggtgccccagaccaggaattcggaatggacattggccctgcctgcttcgtgtaaactccctccatcccaatctggttccctcccacccagcccactttcccccaaccctggaaacagaccaacaacccaaactcaatttccccaaaagccaaaaattgggagacaatttcacatggactttggaaaacatttttttcctttgcattcatctctcaaacttagtttttatctttgaccaactgaacgtgaccaaaaaccaaaagtgcattcaaccttaccaaaaagaaaaaaaaataagaataaataaataactttttaaaaaaggaagcttggtcctcttgcttgaagacctatgtgggtataagtccctttctgcccactgggcttatgataccccaaatgctgccttttctgttcctttctccaccccctcttggggcctctcctccattgctccccaaatttaagtctcccccaaagacacaggaaataatgcattgtctgcccagccagcaaaggcaatgctgaatcgtcccaccagcccctcaacccccagcttacttccctacccagcaccttcaaatcctgccgggacattgggttctcggactattgaaggagcctaaccatctggcatctccatggcctctgcaacaaatccccacacacactttgtttttgagggcctgtgctgggggagccacctgcccctcgcaggggtttggagccaggcagggtcacagcagactggaaacatcggccacacatgtgcaggctgggtgggagagactgttctgttccttgtgtaattgtgttgctgaaagactacctcgttcttgtctttgtgtgtcaccggggcaactgtgtgggggcggggatgggggcagggtggcatcgcgcccagtttggtatcaaaggtgctacatctctgtgaaggggtggggtgggaaggaatttctggtgctatagaatctgagatgctcccctacaccagcaaatgttccttttgttcaaagtatttttttattctttttttttttttaatggatagggacttgtgtgaattttcttttcctgacggtgctatttaacaagggaggagagagtgccaactccagcctgctctctctctacccccctcttcactcttccagctcctgggcctatctgatgatctctctctcttctgaaaccctcccctcttgctgctgctccctaccctcagcttctctctctctctgtcctgcatcagggtttcagagcaccattttccaaagcacaaagcagtttttatccctggggtgggaggaagcaagagactctgtacctattttgtatgtgtataataatttgagatgtttttaattattttgattgctggcataaagcagggggaaatgatccagtccacag

SEQ ID NO: 4485 - DNA, 457 bp, Rattus norvegicus
  Genbank Accession No. AA998576 UI-R-C0-if-e-07-0-UI.s1.del mRNA
caaattacttttttctttttattgagcaaagaaggaggattataaatcaaggaattgttaaaaacggggcttgagaggcaaggatctggcttattcagttgtaaaacagtggaagtaacaattgagttgatccaagagtgctgccattaactagatcagtggttcccactgtagcatattagagagtgatggctgttggttttgaatctgaagtttactaacctcaccgagtagatgcagcctgaggcagaacaaacgccctgctgtgtgtggatgggtcagtcccacacacaaaccgtcctgcacctttacgactgtctaatgtcctgctggacatgtattatgcaggacctacaacttgtctgagaaagaatcctttgattcctctgagacagactgtaatttgtcccgtcttttttatctatcatttcagctaaagtgattttgccctctcctt

SEQ ID NO: 4486 - DNA, 353 bp, Rattus norvegicus
  Genbank Accession No. AI045626 UI-R-C1-ka-e-07-0-UI.s1  mRNA
tttttttttttttttttgaggaaagaacatgcatctatcaagaagctatactaataaaatctcggaggacacctcattaggaatgtttctctttactgctgagacagatgggttatttaattactcagtgtggacatctgcttagctacctgatgatgggagtaacagactgctttagaatagtggccggctctaaagtcccagggagacctgtgtgagatgggcaatgtgtccccatgtcctctccacaactcagacaagcttgttcttaagcggcaggcacatcagcatgatgcagtaaaaggacaaaggatttgtagaacagcccatggcacgcgcactttagtcaccta
